United States Patent
Cheung et al.

(10) Patent No.: US 12,441,793 B2
(45) Date of Patent: Oct. 14, 2025

(54) CD33 ANTIBODIES AND METHODS OF USING THE SAME TO TREAT CANCER

(71) Applicant: MEMORIAL SLOAN KETTERING CANCER CENTER, New York, NY (US)

(72) Inventors: Nai-Kong V. Cheung, New York, NY (US); Sayed Shahabuddin Hoseini, New York, NY (US); Mahiuddin Ahmed, New York, NY (US)

(73) Assignee: Memorial Sloan Kettering Cancer Center, New York, NY (US)

(*) Notice: Subject to any disclaimer, the term of this patent is extended or adjusted under 35 U.S.C. 154(b) by 969 days.

(21) Appl. No.: 17/432,265

(22) PCT Filed: Feb. 21, 2020

(86) PCT No.: PCT/US2020/019351
§ 371 (c)(1),
(2) Date: Aug. 19, 2021

(87) PCT Pub. No.: WO2020/172621
PCT Pub. Date: Aug. 27, 2020

(65) Prior Publication Data
US 2022/0259307 A1    Aug. 18, 2022

Related U.S. Application Data

(60) Provisional application No. 62/809,091, filed on Feb. 22, 2019.

(51) Int. Cl.
| | |
|---|---|
| *C07K 16/28* | (2006.01) |
| *A61K 39/00* | (2006.01) |
| *A61K 39/395* | (2006.01) |
| *A61K 45/06* | (2006.01) |
| *A61K 51/10* | (2006.01) |
| *A61P 25/28* | (2006.01) |
| *A61P 35/02* | (2006.01) |
| *C07K 16/44* | (2006.01) |

(52) U.S. Cl.
CPC ...... *C07K 16/2803* (2013.01); *A61K 39/3955* (2013.01); *A61K 45/06* (2013.01); *A61K 51/1018* (2013.01); *A61K 51/1027* (2013.01); *A61P 25/28* (2018.01); *A61P 35/02* (2018.01); *C07K 16/44* (2013.01); *A61K 2039/505* (2013.01); *C07K 2317/24* (2013.01); *C07K 2317/31* (2013.01); *C07K 2317/34* (2013.01); *C07K 2317/40* (2013.01); *C07K 2317/565* (2013.01); *C07K 2317/92* (2013.01)

(58) Field of Classification Search
None
See application file for complete search history.

(56) References Cited

U.S. PATENT DOCUMENTS

| | | |
|---|---|---|
| 2017/0145086 A1 | 5/2017 | Myette et al. |
| 2017/0210819 A1 | 7/2017 | Cheung et al. |

FOREIGN PATENT DOCUMENTS

| | | |
|---|---|---|
| CN | 101210048 A | 7/2008 |
| CN | 107922480 A | 4/2018 |
| JP | 2015-520758 A | 7/2015 |
| WO | WO-2016/201388 A2 | 12/2016 |
| WO | WO-2017/172981 A2 | 10/2017 |
| WO | WO-2018/102795 A2 | 6/2018 |
| WO | WO-2018/200562 A1 | 11/2018 |
| WO | WO-2019/028283 | 2/2019 |
| WO | WO-2019/224711 A2 | 11/2019 |

OTHER PUBLICATIONS

Nazem et al., J Neuroinflammation (2015) 17; 12: 74 (Year: 2015).*
Lingzhi Zhao, Gerontology 2019; 65:323-331 (Year: 2019).*
Markus Staudt and Matthias M. Herth, Pharmaceuticals 2023, 16, 497 (Year: 2023).*
International Search Report and Written Opinion on PCT Appln. No. PCT/US2020/019351 dated Aug. 4, 2020 (13 pages).
A. B. Perez-Oliva et al: "Epitope mapping, expression and post-translational modifications of two isoforms of CD33 (CD33M and CD33m) on lymphoid and myeloid human cells", Glycobiology, vol. 21, No. 6, Jan. 28, 2011 (Jan. 28, 2011), pp. 757-770.
Hoseini Sayed Shahabuddin et al: "A potent tetravalent T-cell-engaging bispecific antibody against CD33 in acute myeloid leukemia", Blood advances, Jun. 12, 2018 (Jun. 12, 2018), pp. 1250-1258, XP055796686, United States.
Hoseini Sayed Shahabuddin et al: "T cell engaging bispecific antibodies targeting CD33 IgV and IgC domains for the treatment of acute myeloid leukemia", Journal for Immunotherapy of Cancer, vol. 9, No. 5, Apr. 18, 2021 (Apr. 18, 2021), p. e002509, XP055961278.
Jatinder K. Lamba et al: "CD33 Splicing Polymorphism Determines Gemtuzumab Ozogamicin Response in De Novo Acute Myeloid Leukemia: Report From Randomized Phase III Children's Oncology Group Trial AAML0531", Journal of Clinical Oncology, vol. 35, No. 23, Jun. 23, 2017 (Jun. 23, 2017), pp. 2674-2682, XP055579669, US.
Frankel, et al., "Characterization of diphtheria fusion proteins targeted to the human interleukin-3 receptor," Protein Engineering vol. 13 No. 8, 2000, (575-581, pages).
Pakula, et al., "Genetic Analysis of Protein Stability and Function," Division of Biology California Institute of Technology, Anna. Rev. Genet, 1989, vol. 23 (289-310, pages).

* cited by examiner

*Primary Examiner* — Christina M Borgeest
(74) *Attorney, Agent, or Firm* — Foley & Lardner LLP

(57) ABSTRACT

The present disclosure relates generally to immunoglobulin-related compositions (e.g., antibodies or antigen binding fragments thereof) that can bind to the CDS 3 protein. The antibodies of the present technology are useful in methods for detecting and treating Alzheimer's disease or a CDS 3-associated cancer in a subject in need thereof.

22 Claims, 84 Drawing Sheets

Specification includes a Sequence Listing.

| | Full length (IgV+IgC) | short isoform (IgC) | Ref (Pubmed ID) |
|---|---|---|---|
| My96 (p67.6), huMy96 (Gemtuzumab) | + | - | 21278227 |
| M195, huM195 (SGN-33 or Lintuzumab) | + | - | 21278227 |
| WM53 | + | - | 21278227 |
| 4D3 | + | - | 21278227 |
| WM54 | + | - | 21278227 |
| D3HL60.251 | + | - | 21278227 |
| BI 836858 | + | - | 27013443 |
| CAR33VH | + | - | 30524966 |

Figure 2

**Modular
IgG-scFv**

Figure 8

HIM34_VH (murine, humanness 62.2%) (SEQ ID NO: 1)

EVKLQQSGPELVKPGTSVKVSCKASGYSFTDYNMYWVKQSHGKSLEWIGYIDPYKGGTI YNQKFKGKATLTVDKSSSTAFMHLNSLTSEDSAVYYCAREMITAYYFDYWGQGSSVTVS S

HIM34_VH-1 (humanized, humanness 85.7%) (SEQ ID NO: 2)

QVQLQQSGAEVVKPGASVKVSCKASGYSFTDYNMYWVRQAPGQGLEWIGYIDPYKGGT NYAQKFQGRVTMTVDKSSSTAYMELSRLRSDDTAVYYCAREMITAYYFDYWGQGSSVT VSS

HIM34_VH-2 (humanized, humanness 84.7%) (SEQ ID NO: 3)

EVQLQQSGAEVKKPGASVKVSCKASGYSFTDYNMYWVRQAPGQGLEWIGYIDPYKGGT NYAQKFQGRATMTVDKSSSTAYMELSRLRSDDTAVYYCAREMITAYYFDYWGQGSSVT VSS

HIM34_VH-3 (humanized, humanness 86.7%) (SEQ ID NO: 4)

EVQLQQSGAEVKKPGASVKVSCKASGYSFTDYNMYWVRQAPGQGLEWIGYIDPYKGGT NYAQKFQGRVTLTRDKSISTAYMELSRLRSDDTAVYYCAREMITAYYFDYWGQGSSVTV SS

HIM34_VH-4 (humanized, humanness 85.7%) (SEQ ID NO: 5)

QVQLVQSGAEVKKPGASVKVSCKASGYSFTDYNMYWVRQAPGQGLEWIGYIDPYKGGT NYAQKFQGRATLTVDKSSSTAYMELSRLRSDDTAVYYCAREMITAYYFDYWGQGSSVTV SS

HIM34_VH-5 (humanized, humanness 85.7%) (SEQ ID NO: 6)

QVQLQQSGAEVVKPGASVKVSCKASGYSFTDYNMYWVRQAPGQGLEWMGYIDPYKGG TIYNQKFQGRATLTRDTSISTAYMELSRLRSDDTAVYYCAREMITAYYFDYWGQGSSVTV SS

HIM34_VH-6 (humanized, humanness 85.7%) (SEQ ID NO: 7)

QVQLQQSGAEVKKPGASVKVSCKASGYSFTDYNMYWVRQAPGQGLEWMGYIDPYKGG TIYNQKFKGRATLTRDTSISTAYMELSRLRSDDTAVYYCAREMITAYYFDYWGQGSSVTV SS

HIM34_VH-7 (humanness 84.7%) (SEQ ID NO: 133)

QVQLQQSGAEVKKPGASVKVSCKASGYSFTDYNMYWVRQAPGQGLEWIGYIDPYKGGT IYNQKFKGRATLTRDTSISTAYMELSRLRSDDTAVYYCAREMITAYYFDYWGQGSSVTVS S

Figure 9

HIM34_VL (murine, humanness 72.3%) (SEQ ID NO: 8)

DIVMTQSPSSLSASLGGKVTITCKASQDINKYIAWYQHKPGKGPRLLIHYTSTLQPGIPSRFS
GSGSGRDYSFSISNLEPEDIATYYCLQYDNLLTFGAGTKLELK

HIM34_VL-1 (humanized, humanness 88.3%) (SEQ ID NO: 9)

DIQMTQSPSSLSASVGDRVTITCKASQDINKYLNWYQQKPGKAPKLLIHYTSTLQPGIPSRF
SGSGSGTDFTFTISSLQPEDIATYYCLQYDNLLTFGAGTKLELK

HIM34_VL-2 (humanized, humanness 88.3%) (SEQ ID NO: 10)

DIQMTQSPSSLSASVGDRVTITCKASQDINKYLNWYQQKPGKAPKLLIYYTSTLQPGIPSRF
SGSGSGRDFTFTISSLQPEDIATYYCLQYDNLLTFGAGTKLELK

HIM34_VL-3 (humanized, humanness 88.3%) (SEQ ID NO: 11)

DIQMTQSPSSLSASVGDRVTITCKASQDINKYIAWYQHKPGKAPKLLIHYTSTLETGVPSRF
SGSGSGTDFTFTISSLQPEDIATYYCLQYDNLLTFGAGTKLELK

HIM34_VL-4 (humanized, humanness 88.3%) (SEQ ID NO: 12)

DIQMTQSPSSLSASVGDRVTITCKASQDINKYIAWYQHKPGKAPKLLIYYASNLQPGVPSRF
SGSGSGRDFTFTISSLQPEDIATYYCLQYDNLLTFGAGTKLELK

HIM34_VL-5 (humanized, humanness 88.3%) (SEQ ID NO: 13)

DIQMTQSPSSLSASVGDRVTITCKASQDINKYIAWYQQKPGKAPKLLIYYTSTLQPGVPSRF
SGSGSGTDFTFTISSLQPEDIATYYCLQYDNLLTFGAGTKLELK

Figure 10(A)

*Chimeric HIM34 (chHIM34) VL* (SEQ ID NO: 115)

DIVMTQSPSSLSASLGGKVTITCKASQDINKYIAWYQHKPGKGPRLLIHYTSTLQPGIPSRFS
GSGSGRDYSFSISNLEPEDIATYYCLQYDNLLTFGAGTKLELK

*Light chain full amino acid sequence (N to C terminal)* [signal peptide-chHIM34 VL-CL-(G4S)$_3$ linker-hOKT3 VH-(G4S)$_6$ linker-hOKT3 VL] (SEQ ID NO: 14)

<u>MGWSCIILFLVATATGVHS</u>DIVMTQSPSSLSASLGGKVTITCKASQDINKYIAWYQHKP
GKGPRLLIHYTSTLQPGIPSRFSGSGSGRDYSFSISNLEPEDIATYYCLQYDNLLTFGAG
TKLELKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGECTS<u>*GGGGSG*</u>
<u>*GGGSGGGGS*</u>QVQLVQSGGGVVQPGRSLRLSCKASGYTFTRYTMHWVRQAPGKCLEWIGY
INPSRGYTNYNQKFKDRFTISRDNSKNTAFLQMDSLRPEDTGVYFCARYYDDHYSLDYWG
QGTPVTVSS<u>*GGGGSGGGGSGGGGSGGGGSGGGGSGGGGS*</u>DIQMTQSPSSLSASVGDRVTIT
CSASSSVSYMNWYQQTPGKAPKRWIYDTSKLASGVPSRFSGSGSGTDYTFTISSLQPEDIAT
YYCQQWSSNPFTFGCGTKLQITR

*Light chain full nucleotide sequence* (SEQ ID NO: 15)

<u>ATGGGCTGGTCCTGCATCATCCTGTTCCTGGTGGCCACCGCCACCGGCGTGCACAGC</u>GA
CATCGTCATGACTCAGAGCCCTAGCAGCCTGAGCGCATCCCTGGGAGGAAAGGTCACT
ATCACTTGTAAAGCATCACAGGACATCAACAAGTACATCGCCTGGTATCAGCACAAGC
CAGGCAAAGGCCCCCGGCTGCTGATCCACTACACCAGCACACTGCAGCCAGGCATCCC
TTCCCGGTTCAGCGGCTCCGGCTCTGGAAGAGACTACAGCTTTTCCATCTCTAATCTGG
AGCCCGAGGATATCGCCACCTATTATTGTCTGCAGTATGATAATCTGCTGACATTTGGC
GCTGGAACTAAGCTGGAACTGAAACGGACCGTGGCCGCCCCTCCGTGTTCATCTTCCC
CCCCTCCGACGAGCAGCTGAAGTCCGGCACCGCCTCCGTGGTGTGCCTGCTGAACAAC
TTCTACCCCGGGAGGCCAAGGTGCAGTGGAAGGTGGACAACGCCCTGCAGTCCGGCA
ACTCCCAGGAGTCCGTGACCGAGCAGGACTCCAAGGACTCCACCTACTCCCTGTCCTCC
ACCCTGACCCTGTCCAAGGCCGACTACGAGAAGCACAAGGTGTACGCCTGCGAGGTGA
CCCACCAGGGCCTGTCCTCCCCGTGACCAAGTCCTTCAACCGGGGCGAGTGCACTAG
TGGCGGCGGAGGATCTGGCGGAGGTGGAAGCGGAGGGGGAGGATCTCAGGTGCAGCT
GGTGCAGAGCGGAGGCGGAGTGGTGCAGCCTGGCAGATCCCTGAGACTGTCCTGCAAG
GCCTCCGGCTACACCTTCACCCGGTACACCATGCACTGGGTGCGACAGGCCCCTGGCA
AGTGCCTGGAATGGATCGGCTACATCAACCCCTCCCGGGGCTACACCAACTACAACCA
GAAGTTCAAGGACCGGTTCACCATCTCCCGGGACAACTCCAAGAACACCGCCTTTCTG
CAGATGGACTCCCTGCGGCCTGAGGATACCGGCGTGTACTTCTGCGCCCGGTACTACG
ACGACCACTACTCCCTGGACTACTGGGGCCAGGGAACCCCTGTGACAGTGTCATCTGG
TGGCGGAGGAAGTGGGGGAGGCGGATCAGGTGGTGGTGGATCAGGCGGGGGAGGTTC
AGGGGGTGGCGGTTCTGGGGGAGGGGGCTCTGATATTCAGATGACTCAGAGCCCTTCC
AGCCTGAGCGCCTCCGTGGGAGATCGCGTGACAATTACCTGCTCTGCCTCCTCCTCCGT
GTCTTACATGAATTGGTATCAGCAGACCCCTGGGAAGGCTCCTAAGCGGTGGATCTAC
GACACCTCCAAGCTGGCCTCTGGCGTGCCCAGCAGGTTTTCTGGCTCCGGCAGCGGCA
CAGATTATACCTTCACCATCAGCTCCCTGCAGCCAGAAGATATCGCTACCTATTATTGT
CAGCAGTGGTCCTCCAACCCTTTCACCTTCGGCTGCGGCACAAAGCTGCAGATCACAA
GATAG

Figure 10(B)

*chHIM34 VH* (SEQ ID NO: 114)

EVKLQQSGPELVKPGTSVKVSCKASGYSFTDYNMYWVKQSHGKSLEWIGYIDPYKGGTIY
NQKFKGKATLTVDKSSSTAFMHLNSLTSEDSAVYYCAREMITAYYFDYWGQGSSVTVSS

*Heavy chain full amino acid sequence (N to C terminal)* [signal peptide-chHIM34 VH-CH1-3] (SEQ ID NO: 16)

<u>MGWSCIILFLVATATGVHS</u>EVKLQQSGPELVKPGTSVKVSCKASGYSFTDYNMYWVKQ
SHGKSLEWIGYIDPYKGGTIYNQKFKGKATLTVDKSSSTAFMHLNSLTSEDSAVYYCA
REMITAYYFDYWGQGSSVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKRVE
PKSCDKTHTCPPCPAPELLGGPSVFLFPPKPKDTLMISRTPEVTCVVVDVSHEDPEVKFNWY
VDGVEVHNAKTKPREEQYASTYRVVSVLTVLHQDWLNGKEYKCAVSNKALPAPIEKTISK
AKGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGK

*Heavy chain full nucleotide sequence* (SEQ ID NO: 17)

<u>ATGGGCTGGTCCTGCATCATCCTGTTCCTGGTGGCCACCGCCACCGGCGTGCACAGCGA</u>
AGTGAAACTGCAGCAGAGCGGCCCTGAACTGGTCAAACCTGGAACCTCCGTGAAAGTG
TCTTGTAAAGCATCCGGGTACTCATTCACCGACTACAACATGTATTGGGTGAAGCAGA
GCCACGGCAAGTCCCTGGAGTGGATCGGCTACATCGACCCCTATAAGGGCGGCACAAT
CTACAACCAGAAGTTCAAGGGCAAGGCCACCCTGACAGTGGACAAGAGCTCCTCTACC
GCCTTTATGCACCTGAATAGCCTGACATCCGAGGATTCTGCCGTGTACTATTGCGCCCG
GGAGATGATTACAGCCTACTACTTTGATTACTGGGGACAGGGGTCTTCCGTCACCGTCT
CCTCTGCCTCCACCAAGGGcCCCTCTGTGTTTCCTCTGGCCCCCTCCAGCAAGTCCACCT
CTGGTGGAACAGCCGCCCTGGGCTGCCTCGTGAAGGACTACTTTCCCGAGCCCGTGAC
CGTGTCCTGGAACTCTGGCGCTCTGACCTCTGGCGTGCACACCTTCCCTGCTGTGCTGC
AGTCTAGCGGCCTGTACTCCCTGTCCTCCGTCGTGACAGTGCCCTCCAGCTCTCTGGGC
ACCCAGACCTACATCTGCAACGTGAACCACAAGCCCTCCAATACCAAGGTGGACAAGC
GGGTGGAACCCAAGTCCTGCGACAAGACCCACACCTGTCCCCCTTGTCCTGCCCCTGA
ACTGCTGGGCGGACCTTCCGTGTTCCTGTTCCCCCCAAAGCCCAAGGACACCCTGATGA
TCTCCCGGACCCCCGAAGTGACCTGCGTGGTGGTGGATGTGTCCCACGAGGACCCTGA
AGTGAAGTTCAATTGGTACGTGGACGGCGTGGAAGTGCACAACGCCAAGACCAAGCCT
AGAGAGGAACAGTACGCCTCCACCTACCGGGTGGTGTCCGTGCTGACAGTGCTGCACC
AGGACTGGCTGAACGGCAAAGAGTACAAGTGCGCCGTGTCCAACAAGGCCCTGCCTGC
CCCCATCGAAAAGACCATCTCCAAGGCCAAGGGCCAGCCCCGGGAACCCCAGGTGTAC
ACACTGCCCCCTAGCAGGGACGAGCTGACCAAGAACCAGGTGTCCCTGACCTGTCTCG
TGAAAGGCTTCTACCCCTCCGATATCGCCGTGGAATGGGAGTCCAACGGCCAGCCTGA
GAACAACTACAAGACCACCCCCCCTGTGCTGGACTCCGACGGCTCATTCTTCCTGTACA
GCAAGCTGACCGTGGACAAGTCCCGGTGGCAGCAGGGCAACGTGTTCTCCTGCTCCGT
GATGCACGAGGCCCTGCACAACCACTACACCCAGAAGTCCCTGTCCCTGAGCCCCGGC
AAATGA

Figure 11(A)

BC249 (hHIM34_VL3VH5) light chain

*Light chain full amino acid sequence (N to C terminal)* - [signal peptide-hHIM34 VL-3-CL-(G4S)3 linker-hOKT3 VH-(G4S)6 linker-hOKT3 VL] (SEQ ID NO: 18)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGECTS*GGGGSG*
*GGGSGGGGS*QVQLVQSGGGVVQPGRSLRLSCKASGYTFTRYTMHWVRQAPGKCLEWIGY
INPSRGYTNYNQKFKDRFTISRDNSKNTAFLQMDSLRPEDTGVYFCARYYDDHYSLDYWG
QGTPVTVSS*GGGGSGGGGSGGGGSGGGGSGGGGSGGGGS*DIQMTQSPSSLSASVGDRVTIT
CSASSSVSYMNWYQQTPGKAPKRWIYDTSKLASGVPSRFSGSGSGTDYTFTISSLQPEDIAT
YYCQQWSSNPFTFGCGTKLQITR

*Light chain full nucleotide sequence* (SEQ ID NO: 19)

<u>ATGGGCTGGTCCTGCATCATCCTGTTCCTGGTGGCCACCGCCACCGGCGTGCACAGC</u>GA
CATCCAGATGACCCAGTCCCCAAGCTCCCTGTCCGCCTCTGTGGGCGACCGGGTGACC
ATCACATGCAAGGCCTCCCAGGATATCAACAAGTACATCGCCTGGTATCAGCACAAGC
CCGGCAAGGCCCCTAAGCTGCTGATCCACTACACCTCTACACTGGAGACCGGCGTGCC
AAGCAGATTCAGCGGCTCCGGCTCTGGCACAGATTTCACCTTTACAATCTCTAGCCTGC
AGCCCGAGGACATCGCCACATACTATTGTCTGCAGTATGATAATCTGCTGACCTTTGGC
GCCGGCACAAAGCTGGAGCTGAAGCGGACCGTGGCCGCCCCTCCGTGTTCATCTTCC
CCCCCTCCGACGAGCAGCTGAAGTCCGGCACCGCCTCCGTGGTGTGCCTGCTGAACAA
CTTCTACCCCGGGAGGCCAAGGTGCAGTGGAAGGTGGACAACGCCCTGCAGTCCGGC
AACTCCCAGGAGTCCGTGACCGAGCAGGACTCCAAGGACTCCACCTACTCCCTGTCCT
CCACCCTGACCCTGTCCAAGGCCGACTACGAGAAGCACAAGGTGTACGCCTGCGAGGT
GACCCACCAGGGCCTGTCCTCCCCGTGACCAAGTCCTTCAACCGGGGCGAGTGCACT
AGTGGCGGCGGAGGATCTGGCGGAGGTGGAAGCGGAGGGGGAGGATCTCAGGTGCAG
CTGGTGCAGAGCGGAGGCGGAGTGGTGCAGCCTGGCAGATCCCTGAGACTGTCCTGCA
AGGCCTCCGGCTACACCTTCACCCGGTACACCATGCACTGGGTGCGACAGGCCCCTGG
CAAGTGCCTGGAATGGATCGGCTACATCAACCCCTCCCGGGGCTACACCAACTACAAC
CAGAAGTTCAAGGACCGGTTCACCATCTCCCGGGACAACTCCAAGAACACCGCCTTTC
TGCAGATGGACTCCCTGCGGCCTGAGGATACCGGCGTGTACTTCTGCGCCCGGTACTAC
GACGACCACTACTCCCTGGACTACGGGGCCAGGGAACCCCTGTGACAGTGTCATCTG
GTGGCGGAGGAAGTGGGGGAGGCGGATCAGGTGGTGGTGGATCAGGCGGGGAGGTT
CAGGGGGTGGCGGTTCTGGGGGAGGGGCTCTGATATTCAGATGACTCAGAGCCCTTC
CAGCCTGAGCGCCTCCGTGGGAGATCGCGTGACAATTACCTGCTCTGCCTCCTCCTCCG
TGTCTTACATGAATTGGTATCAGCAGACCCCTGGGAAGGCTCCTAAGCGGTGGATCTA
CGACACCTCCAAGCTGGCCTCTGGCGTGCCCAGCAGGTTTCTGGCTCCGGCAGCGGC
ACAGATTATACCTTCACCATCAGCTCCCTGCAGCCAGAAGATATCGCTACCTATTATTG
TCAGCAGTGGTCCTCCAACCCTTTCACCTTCGGCTGCGGCACAAAGCTGCAGATCACAA
GATAG

Figure 11(B)

BC249 (hHIM34_VL3VH5) heavy chain

*Heavy chain full amino acid sequence (N to C terminal)* [signal peptide-hHIM34 VH-5-CH1-3]
(SEQ ID NO: 20)

MGWSCIILFLVATATGVHSQVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFN
WYVDGVEVHNAKTKPREEQYASTYRVVSVLTVLHQDWLNGKEYKCAVSNKALPAPIEKT
ISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

*Heavy chain full nucleotide sequence* (SEQ ID NO: 21)

ATGGGCTGGTCCTGCATCATCCTGTTCCTGGTGGCCACCGCCACCGGCGTGCACAGCCA
GGTGCAGCTGCAGCAGTCCGGAGCAGAGGTGGTGAAGCCAGGAGCCTCTGTGAAGGT
GAGCTGCAAGGCCAGCGGCTACTCCTTCACCGACTACAACATGTATTGGGTGCGGCAG
GCACCAGGACAGGGCCTGGAGTGGATGGGCTACATCGACCCTTATAAGGGCGGCACA
ATCTACAATCAGAAGTTTCAGGGAAGGGCCACCCTGACAAGGGACACCTCCATCTCTA
CAGCCTATATGGAGCTGTCCCGGCTGAGATCTGACGATACCGCCGTGTACTATTGTGCC
AGGGAGATGATCACAGCCTACTATTTCGATTATTGGGGCCAGGGCAGCTCCGTGACCG
TGTCTAGCGCCTCCACCAAGGGCCCCTCTGTGTTTCCTCTGGCCCCCTCCAGCAAGTCC
ACCTCTGGTGGAACAGCCGCCCTGGGCTGCCTCGTGAAGGACTACTTTCCCGAGCCCGT
GACCGTGTCCTGGAACTCTGGCGCTCTGACCTCTGGCGTGCACACCTTCCCTGCTGTGC
TGCAGTCTAGCGGCCTGTACTCCCTGTCCTCCGTCGTGACAGTGCCCTCCAGCTCTCTG
GGCACCCAGACCTACATCTGCAACGTGAACCACAAGCCCTCCAATACCAAGGTGGACA
AGCGGGTGGAACCCAAGTCCTGCGACAAGACCCACACCTGTCCCCCTTGTCCTGCCCCT
GAACTGCTGGGCGGACCTTCCGTGTTCCTGTTCCCCCCAAAGCCCAAGGACACCCTGAT
GATCTCCCGGACCCCCGAAGTGACCTGCGTGGTGGTGGATGTGTCCCACGAGGACCCT
GAAGTGAAGTTCAATTGGTACGTGGACGGCGTGGAAGTGCACAACGCCAAGACCAAG
CCTAGAGAGGAACAGTACGCCTCCACCTACCGGGTGGTGTCCGTGCTGACAGTGCTGC
ACCAGGACTGGCTGAACGGCAAAGAGTACAAGTGCGCCGTGTCCAACAAGGCCCTGCC
TGCCCCCATCGAAAAGACCATCTCCAAGGCCAAGGGCCAGCCCCGGGAACCCCAGGTG
TACACACTGCCCCCTAGCAGGGACGAGCTGACCAAGAACCAGGTGTCCCTGACCTGTC
TCGTGAAAGGCTTCTACCCCTCCGATATCGCCGTGGAATGGGAGTCCAACGGCCAGCC
TGAGAACAACTACAAGACCACCCCCCCTGTGCTGGACTCCGACGGCTCATTCTTCCTGT
ACAGCAAGCTGACCGTGGACAAGTCCCGGTGGCAGCAGGGCAACGTGTTCTCCTGCTC
CGTGATGCACGAGGCCCTGCACAACCACTACACCCAGAAGTCCCTGTCCCTGAGCCCC
GGCAAATGA

Figure 11(C)

*BC275 (hHIM34 L4H5)*

*BC275 Light chain full amino acid sequence (N to C terminal)* [signal peptide-hHIM34 VL4-CL-(G4S)₃ linker-hOKT3 VH-(G4S)₆ linker-hOKT3 VL] (SEQ ID NO: 134)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKRTVAAPSVFIFPPSDEQLKSGTASVVCLLNNFYPREAKVQWKVDNALQSGNSQ
ESVTEQDSKDSTYSLSSTLTLSKADYEKHKVYACEVTHQGLSSPVTKSFNRGECTS*GGGGS*
*GGGGSGGGGS*QVQLVQSGGGVVQPGRSLRLSCKASGYTFTRYTMHWVRQAPGKCLEWIG
YINPSRGYTNYNQKFKDRFTISRDNSKNTAFLQMDSLRPEDTGVYFCARYYDDHYSLDYW
GQGTPVTVSS*GGGGSGGGGSGGGGSGGGGSGGGGSGGGGS*DIQMTQSPSSLSASVGDRVTI
TCSASSSVSYMNWYQQTPGKAPKRWIYDTSKLASGVPSRFSGSGSGTDYTFTISSLQPEDIA
TYYCQQWSSNPFTFGCGTKLQITR

*Light chain full nucleotide sequence* (SEQ ID NO: 135)

<u>ATGGGCTGGTCCTGCATCATCCTGTTCCTGGTGGCCACCGCCACCGGCGTGCACAGCGA</u>
CATCCAGATGACCCAGTCCCCTAGCTCCCTGTCCGCCTCTGTGGGCGACAGGGTGACCA
TCACATGCAAGGCCTCCCAGGATATCAACAAGTACATCGCCTGGTATCAGCACAAGCC
AGGCAAGGCCCCCAAGCTGCTGATCTACTATGCCTCTAATCTGCAGCCAGGAGTGCCT
AGCCGGTTCAGCGGCTCCGGCTCTGGAAGAGATTTCACCTTTACAATCTCTAGCCTGCA
GCCCGAGGACATCGCCACATACTATTGTCTGCAGTACGATAACCTGCTGACCTTTGGCG
CCGGCACAAAGCTGGAGCTGAAGCGGACCGTGGCCGCCCCTCCGTGTTCATCTTCCC
CCCCTCCGACGAGCAGCTGAAGTCCGGCACCGCCTCCGTGGTGTGCCTGCTGAACAAC
TTCTACCCCCGGGAGGCCAAGGTGCAGTGGAAGGTGGACAACGCCCTGCAGTCCGGCA
ACTCCCAGGAGTCCGTGACCGAGCAGGACTCCAAGGACTCCACCTACTCCCTGTCCTCC
ACCCTGACCCTGTCCAAGGCCGACTACGAGAAGCACAAGGTGTACGCCTGCGAGGTGA
CCCACCAGGGCCTGTCCTCCCCGTGACCAAGTCCTTCAACCGGGGCGAGTGCACTAG
TGGCGGCGGAGGATCTGGCGGAGGTGGAAGCGGAGGGGGAGGATCTCAGGTGCAGCT
GGTGCAGAGCGGAGGCGGAGTGGTGCAGCCTGGCAGATCCCTGAGACTGTCCTGCAAG
GCCTCCGGCTACACCTTCACCCGGTACACCATGCACTGGGTGCGACAGGCCCCTGGCA
AGTGCCTGGAATGGATCGGCTACATCAACCCCTCCCGGGGCTACACCAACTACAACCA
GAAGTTCAAGGACCGGTTCACCATCTCCCGGGACAACTCCAAGAACACCGCCTTTCTG
CAGATGGACTCCCTGCGGCCTGAGGATACCGGCGTGTACTTCTGCGCCCGGTACTACG
ACGACCACTACTCCCTGGACTACTGGGGCCAGGGAACCCCTGTGACAGTGTCATCTGG
TGGCGGAGGAAGTGGGGGAGGCGGATCAGGTGGTGGTGGATCAGGCGGGGGAGGTTC
AGGGGGTGGCGGTTCTGGGGAGGGGCTCTGATATTCAGATGACTCAGAGCCCTTCC
AGCCTGAGCGCCTCCGTGGGAGATCGCGTGACAATTACCTGCTCTGCCTCCTCCTCCGT
GTCTTACATGAATTGGTATCAGCAGACCCCTGGGAAGGCTCCTAAGCGGTGGATCTAC
GACACCTCCAAGCTGGCCTCTGGCGTGCCCAGCAGGTTTCTGGCTCCGGCAGCGGCA
CAGATTATACCTTCACCATCAGCTCCCTGCAGCCAGAAGATATCGCTACCTATTATTGT
CAGCAGTGGTCCTCCAACCCTTTCACCTTCGGCTGCGGCACAAAGCTGCAGATCACAA
GATAG

Figure 11(D)

*BC275 Heavy chain full amino acid sequence (N to C terminal)* [signal peptide-hHIM34 VH5-CH1-3] (SEQ ID NO: 136)

MGWSCIILFLVATATGVHSQVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFN
WYVDGVEVHNAKTKPREEQYASTYRVVSVLTVLHQDWLNGKEYKCAVSNKALPAPIEKT
ISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

*Heavy chain full nucleotide sequence* (SEQ ID NO: 137)

ATGGGCTGGTCCTGCATCATCCTGTTCCTGGTGGCCACCGCCACCGGCGTGCACAGCCA
GGTGCAGCTGCAGCAGTCCGGAGCAGAGGTGGTGAAGCCAGGAGCCTCTGTGAAGGT
GAGCTGCAAGGCCAGCGGCTACTCCTTCACCGACTACAACATGTATTGGGTGCGGCAG
GCACCAGGACAGGGCCTGGAGTGGATGGGCTACATCGACCCTTATAAGGGCGGCACA
ATCTACAATCAGAAGTTTCAGGGAAGGGCCACCCTGACAAGGGACACCTCCATCTCTA
CAGCCTATATGGAGCTGTCCCGGCTGAGATCTGACGATACCGCCGTGTACTATTGTGCC
AGGGAGATGATCACAGCCTACTATTTCGATTATTGGGGCCAGGGCAGCTCCGTGACCG
TGTCTAGCGCCTCCACCAAGGGCCCCTCTGTGTTTCCTCTGGCCCCCTCCAGCAAGTCC
ACCTCTGGTGGAACAGCCGCCCTGGGCTGCCTCGTGAAGGACTACTTTCCCGAGCCCGT
GACCGTGTCCTGGAACTCTGGCGCTCTGACCTCTGGCGTGCACACCTTCCCTGCTGTGC
TGCAGTCTAGCGGCCTGTACTCCCTGTCCTCCGTCGTGACAGTGCCCTCCAGCTCTCTG
GGCACCCAGACCTACATCTGCAACGTGAACCACAAGCCCTCCAATACCAAGGTGGACA
AGCGGGTGGAACCCAAGTCCTGCGACAAGACCCACACCTGTCCCCCTTGTCCTGCCCCT
GAACTGCTGGGCGGACCTTCCGTGTTCCTGTTCCCCCCAAAGCCCAAGGACACCCTGAT
GATCTCCCGGACCCCCGAAGTGACCTGCGTGGTGGTGGATGTGTCCCACGAGGACCCT
GAAGTGAAGTTCAATTGGTACGTGGACGGCGTGGAAGTGCACAACGCCAAGACCAAG
CCTAGAGAGGAACAGTACGCCTCCACCTACCGGGTGGTGTCCGTGCTGACAGTGCTGC
ACCAGGACTGGCTGAACGGCAAAGAGTACAAGTGCGCCGTGTCCAACAAGGCCCTGCC
TGCCCCCATCGAAAAGACCATCTCCAAGGCCAAGGGCCAGCCCCGGGAACCCCAGGTG
TACACACTGCCCCCTAGCAGGGACGAGCTGACCAAGAACCAGGTGTCCCTGACCTGTC
TCGTGAAAGGCTTCTACCCCTCCGATATCGCCGTGGAATGGGAGTCCAACGGCCAGCC
TGAGAACAACTACAAGACCACCCCCCTGTGCTGGACTCCGACGGCTCATTCTTCCTGT
ACAGCAAGCTGACCGTGGACAAGTCCCGGTGGCAGCAGGGCAACGTGTTCTCCTGCTC
CGTGATGCACGAGGCCCTGCACAACCACTACACCCAGAAGTCCCTGTCCCTGAGCCCC
GGCAAATGA

Figure 12(A)

BC267 (hHIM34_VL3VH6) light chain

*Light chain full amino acid sequence (N to C terminal)* [signal peptide-hHIM34 VL-3-CL-(G4S)₃ linker-hOKT3 VH-(G4S)₆ linker-hOKT3 VL] (SEQ ID NO: 18)

MGWSCIILFLVATATGVHSDIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGECTS*GGGGSG*
*GGGSGGGGS*QVQLVQSGGGVVQPGRSLRLSCKASGYTFTRYTMHWVRQAPGKCLEWIGY
INPSRGYTNYNQKFKDRFTISRDNSKNTAFLQMDSLRPEDTGVYFCARYYDDHYSLDYWG
QGTPVTVSS*GGGGSGGGGSGGGGSGGGGSGGGGSGGGGS*DIQMTQSPSSLSASVGDRVTIT
CSASSSVSYMNWYQQTPGKAPKRWIYDTSKLASGVPSRFSGSGSGTDYTFTISSLQPEDIAT
YYCQQWSSNPFTFGCGTKLQITR

*Light chain full nucleotide sequence* (SEQ ID NO: 19)

ATGGGCTGGTCCTGCATCATCCTGTTCCTGGTGGCCACCGCCACCGGCGTGCACAGCGA
CATCCAGATGACCCAGTCCCCAAGCTCCCTGTCCGCCTCTGTGGGCGACCGGGTGACC
ATCACATGCAAGGCCTCCCAGGATATCAACAAGTACATCGCCTGGTATCAGCACAAGC
CCGGCAAGGCCCCTAAGCTGCTGATCCACTACACCTCTACACTGGAGACCGGCGTGCC
AAGCAGATTCAGCGGCTCCGGCTCTGGCACAGATTTCACCTTTACAATCTCTAGCCTGC
AGCCCGAGGACATCGCCACATACTATTGTCTGCAGTATGATAATCTGCTGACCTTTGGC
GCCGGCACAAAGCTGGAGCTGAAGCGGACCGTGGCCGCCCCCTCCGTGTTCATCTTCC
CCCCCTCCGACGAGCAGCTGAAGTCCGGCACCGCCTCCGTGGTGTGCCTGCTGAACAA
CTTCTACCCCGGGAGGCCAAGGTGCAGTGGAAGGTGGACAACGCCCTGCAGTCCGGC
AACTCCCAGGAGTCCGTGACCGAGCAGGACTCCAAGGACTCCACCTACTCCCTGTCCT
CCACCCTGACCCTGTCCAAGGCCGACTACGAGAAGCACAAGGTGTACGCCTGCGAGGT
GACCCACCAGGGCCTGTCCTCCCCCGTGACCAAGTCCTTCAACCGGGGCGAGTGCACT
AGTGGCGGCGGAGGATCTGGCGGAGGTGGAAGCGGAGGGGGAGGATCTCAGGTGCAG
CTGGTGCAGAGCGGAGGCGGAGTGGTGCAGCCTGGCAGATCCCTGAGACTGTCCTGCA
AGGCCTCCGGCTACACCTTCACCCGGTACACCATGCACTGGGTGCGACAGGCCCCTGG
CAAGTGCCTGGAATGGATCGGCTACATCAACCCCTCCCGGGGCTACACCAACTACAAC
CAGAAGTTCAAGGACCGGTTCACCATCTCCCGGGACAACTCCAAGAACACCGCCTTTC
TGCAGATGGACTCCCTGCGGCCTGAGGATACCGGCGTGTACTTCTGCGCCCGGTACTAC
GACGACCACTACTCCCTGGACTACTGGGGCCAGGGAACCCCTGTGACAGTGTCATCTG
GTGGCGGAGGAAGTGGGGGAGGCGGATCAGGTGGTGGTGGATCAGGCGGGGGAGGTT
CAGGGGGTGGCGGTTCTGGGGGAGGGGGCTCTGATATTCAGATGACTCAGAGCCCTTC
CAGCCTGAGCGCCTCCGTGGGAGATCGCGTGACAATTACCTGCTCTGCCTCCTCCTCCG
TGTCTTACATGAATTGGTATCAGCAGACCCCTGGGAAGGCTCCTAAGCGGTGGATCTA
CGACACCTCCAAGCTGGCCTCTGGCGTGCCCAGCAGGTTTTCTGGCTCCGGCAGCGGC
ACAGATTATACCTTCACCATCAGCTCCCTGCAGCCAGAAGATATCGCTACCTATTATTG
TCAGCAGTGGTCCTCCAACCCTTTCACCTTCGGCTGCGGCACAAAGCTGCAGATCACAA
GATAG

Figure 12(B)

BC267 (hHIM34_VL3VH6) heavy chain

*Heavy chain full amino acid sequence (N to C terminal)* [signal peptide-hHIM34 VH-6-CH1-3]
(SEQ ID NO: 22)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFN
WYVDGVEVHNAKTKPREEQYASTYRVVSVLTVLHQDWLNGKEYKCAVSNKALPAPIEKT
ISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

*Heavy chain full nucleotide sequence* (SEQ ID NO: 23)

ATGGGCTGGTCCTGCATCATCCTGTTCCTGGTGGCCACCGCCACCGGCGTGCACAGCCA
GGTGCAGCTGCAGCAGTCCGGAGCAGAGGTGAAGAAGCCAGGAGCCTCTGTGAAGGT
GAGCTGCAAGGCCAGCGGCTACTCCTTCACCGACTACAACATGTATTGGGTGCGGCAG
GCACCAGGACAGGGCCTGGAGTGGATGGGCTACATCGACCCTTATAAGGGCGGCACA
ATCTACAATCAGAAGTTTAAGGGAAGGGCCACCCTGACAAGGGACACCTCCATCTCTA
CAGCCTATATGGAGCTGTCCCGGCTGAGATCTGACGATACCGCCGTGTACTATTGTGCC
AGGGAGATGATCACAGCCTACTATTTCGATTATTGGGGCCAGGGCAGCTCCGTGACCG
TGTCTAGCGCCTCCACCAAGGGCCCCTCTGTGTTTCCTCTGGCCCCTCCAGCAAGTCC
ACCTCTGGTGGAACAGCCGCCCTGGGCTGCCTCGTGAAGGACTACTTTCCCGAGCCCGT
GACCGTGTCCTGGAACTCTGGCGCTCTGACCTCTGGCGTGCACACCTTCCCTGCTGTGC
TGCAGTCTAGCGGCCTGTACTCCCTGTCCTCCGTCGTGACAGTGCCCTCCAGCTCTCTG
GGCACCCAGACCTACATCTGCAACGTGAACCACAAGCCCTCCAATACCAAGGTGGACA
AGCGGGTGGAACCCAAGTCCTGCGACAAGACCCACACCTGTCCCCCTTGTCCTGCCCCT
GAACTGCTGGGCGGACCTTCCGTGTTCCTGTTCCCCCCAAAGCCCAAGGACACCCTGAT
GATCTCCCGGACCCCCGAAGTGACCTGCGTGGTGGTGGATGTGTCCCACGAGGACCCT
GAAGTGAAGTTCAATTGGTACGTGGACGGCGTGGAAGTGCACAACGCCAAGACCAAG
CCTAGAGAGGAACAGTACGCCTCCACCTACCGGGTGGTGTCCGTGCTGACAGTGCTGC
ACCAGGACTGGCTGAACGGCAAAGAGTACAAGTGCGCCGTGTCCAACAAGGCCCTGCC
TGCCCCCATCGAAAAGACCATCTCCAAGGCCAAGGGCCAGCCCCGGGAACCCCAGGTG
TACACACTGCCCCCTAGCAGGGACGAGCTGACCAAGAACCAGGTGTCCCTGACCTGTC
TCGTGAAAGGCTTCTACCCCTCCGATATCGCCGTGGAATGGGAGTCCAACGGCCAGCC
TGAGAACAACTACAAGACCACCCCCCCTGTGCTGGACTCCGACGGCTCATTCTTCCTGT
ACAGCAAGCTGACCGTGGACAAGTCCCGGTGGCAGCAGGGCAACGTGTTCTCCTGCTC
CGTGATGCACGAGGCCCTGCACAACCACTACACCCAGAAGTCCCTGTCCCTGAGCCCC
GGCAAATGA

Figure 13(A)

BC268 (hHIM34_VL4VH6) light chain

*Light chain full amino acid sequence (N to C terminal)* [signal peptide-hHIM34 VL-4-CL-(G4S)₃ linker-hOKT3 VH-(G4S)₆ linker-hOKT3 VL] (SEQ ID NO: 24)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKRTVAAPSVFIFPPSDEQLKSGTASVVCLLNNFYPREAKVQWKVDNALQSGNSQ
ESVTEQDSKDSTYSLSSTLTLSKADYEKHKVYACEVTHQGLSSPVTKSFNRGECTS*GGGGS*
*GGGGSGGGGS*QVQLVQSGGGVVQPGRSLRLSCKASGYTFTRYTMHWVRQAPGKCLEWIG
YINPSRGYTNYNQKFKDRFTISRDNSKNTAFLQMDSLRPEDTGVYFCARYYDDHYSLDYW
GQGTPVTVSS*GGGGSGGGGSGGGGSGGGGSGGGGSGGGGS*DIQMTQSPSSLSASVGDRVTI
TCSASSSVSYMNWYQQTPGKAPKRWIYDTSKLASGVPSRFSGSGSGTDYTFTISSLQPEDIA
TYYCQQWSSNPFTFGCGTKLQITR

*Light chain full nucleotide sequence* (SEQ ID NO: 25)

ATGGGCTGGTCCTGCATCATCCTGTTCCTGGTGGCCACCGCCACCGGCGTGCACAGCGA
CATCCAGATGACCCAGTCCCCTAGCTCCCTGTCCGCCTCTGTGGGCGACAGGGTGACCA
TCACATGCAAGGCCTCCCAGGATATCAACAAGTACATCGCCTGGTATCAGCACAAGCC
AGGCAAGGCCCCCAAGCTGCTGATCTACTATGCCTCTAATCTGCAGCCAGGAGTGCCT
AGCCGGTTCAGCGGCTCCGGCTCTGGAAGAGATTTCACCTTTACAATCTCTAGCCTGCA
GCCCGAGGACATCGCCACATACTATTGTCTGCAGTACGATAACCTGCTGACCTTTGGCG
CCGGCACAAAGCTGGAGCTGAAGCGGACCGTGGCCGCCCCTCCGTGTTCATCTTCCC
CCCCTCCGACGAGCAGCTGAAGTCCGGCACCGCCTCCGTGGTGTGCCTGCTGAACAAC
TTCTACCCCGGGAGGCCAAGGTGCAGTGGAAGGTGGACAACGCCCTGCAGTCCGGCA
ACTCCCAGGAGTCCGTGACCGAGCAGGACTCCAAGGACTCCACCTACTCCCTGTCCTCC
ACCCTGACCCTGTCCAAGGCCGACTACGAGAAGCACAAGGTGTACGCCTGCGAGGTGA
CCCACCAGGGCCTGTCCTCCCCGTGACCAAGTCCTTCAACCGGGGCGAGTGCACTAG
TGGCGGCGGAGGATCTGGCGGAGGTGGAAGCGGAGGGGGAGGATCTCAGGTGCAGCT
GGTGCAGAGCGGAGGCGGAGTGGTGCAGCCTGGCAGATCCCTGAGACTGTCCTGCAAG
GCCTCCGGCTACACCTTCACCCGGTACACCATGCACTGGGTGCGACAGGCCCCTGGCA
AGTGCCTGGAATGGATCGGCTACATCAACCCCTCCCGGGGCTACACCAACTACAACCA
GAAGTTCAAGGACCGGTTCACCATCTCCCGGGACAACTCCAAGAACACCGCCTTTCTG
CAGATGGACTCCCTGCGGCCTGAGGATACCGGCGTGTACTTCTGCGCCCGGTACTACG
ACGACCACTACTCCCTGGACTACTGGGGCCAGGGAACCCCTGTGACAGTGTCATCTGG
TGGCGGAGGAAGTGGGGGAGGCGGATCAGGTGGTGGTGGATCAGGCGGGGGAGGTTC
AGGGGGTGGCGGTTCTGGGGGAGGGGCTCTGATATTCAGATGACTCAGAGCCCTTCC
AGCCTGAGCGCCTCCGTGGGAGATCGCGTGACAATTACCTGCTCTGCCTCCTCCTCCGT
GTCTTACATGAATTGGTATCAGCAGACCCCTGGGAAGGCTCCTAAGCGGTGGATCTAC
GACACCTCCAAGCTGGCCTCTGGCGTGCCCAGCAGGTTTTCTGGCTCCGGCAGCGGCA
CAGATTATACCTTCACCATCAGCTCCCTGCAGCCAGAAGATATCGCTACCTATTATTGT
CAGCAGTGGTCCTCCAACCCTTTCACCTTCGGCTGCGGCACAAAGCTGCAGATCACAA
GATAG

Figure 13(B)

BC268 (hHIM34_VL4VH6) heavy chain

*Heavy chain full amino acid sequence (N to C terminal)* [signal peptide-hHIM34 VH-6-CH1-3]
(SEQ ID NO: 22)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFN
WYVDGVEVHNAKTKPREEQYASTYRVVSVLTVLHQDWLNGKEYKCAVSNKALPAPIEKT
ISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

*Heavy chain full nucleotide sequence* (SEQ ID NO: 23)

ATGGGCTGGTCCTGCATCATCCTGTTCCTGGTGGCCACCGCCACCGGCGTGCACAGCCA
GGTGCAGCTGCAGCAGTCCGGAGCAGAGGTGAAGAAGCCAGGAGCCTCTGTGAAGGT
GAGCTGCAAGGCCAGCGGCTACTCCTTCACCGACTACAACATGTATTGGGTGCGGCAG
GCACCAGGACAGGGCCTGGAGTGGATGGGCTACATCGACCCTTATAAGGGCGGCACA
ATCTACAATCAGAAGTTTAAGGGAAGGGCCACCCTGACAAGGGACACCTCCATCTCTA
CAGCCTATATGGAGCTGTCCCGGCTGAGATCTGACGATACCGCCGTGTACTATTGTGCC
AGGGAGATGATCACAGCCTACTATTTCGATTATGGGGCCAGGGCAGCTCCGTGACCG
TGTCTAGCGCCTCCACCAAGGGCCCCTCTGTGTTTCCTCTGGCCCCTCCAGCAAGTCC
ACCTCTGGTGGAACAGCCGCCCTGGGCTGCCTCGTGAAGGACTACTTTCCCGAGCCCGT
GACCGTGTCCTGGAACTCTGGCGCTCTGACCTCTGGCGTGCACACCTTCCCTGCTGTGC
TGCAGTCTAGCGGCCTGTACTCCCTGTCCTCCGTCGTGACAGTGCCCTCCAGCTCTCTG
GGCACCCAGACCTACATCTGCAACGTGAACCACAAGCCCTCCAATACCAAGGTGGACA
AGCGGGTGGAACCCAAGTCCTGCGACAAGACCCACACCTGTCCCCCTTGTCCTGCCCCT
GAACTGCTGGGCGGACCTTCCGTGTTCCTGTTCCCCCCAAAGCCCAAGGACACCCTGAT
GATCTCCCGGACCCCCGAAGTGACCTGCGTGGTGGTGGATGTGTCCCACGAGGACCCT
GAAGTGAAGTTCAATTGGTACGTGGACGGCGTGGAAGTGCACAACGCCAAGACCAAG
CCTAGAGAGGAACAGTACGCCTCCACCTACCGGGTGGTGTCCGTGCTGACAGTGCTGC
ACCAGGACTGGCTGAACGGCAAAGAGTACAAGTGCGCCGTGTCCAACAAGGCCCTGCC
TGCCCCCATCGAAAAGACCATCTCCAAGGCCAAGGGCCAGCCCCGGGAACCCCAGGTG
TACACACTGCCCCCTAGCAGGGACGAGCTGACCAAGAACCAGGTGTCCCTGACCTGTC
TCGTGAAAGGCTTCTACCCCTCCGATATCGCCGTGGAATGGGAGTCCAACGGCCAGCC
TGAGAACAACTACAAGACCACCCCCCCTGTGCTGGACTCCGACGGCTCATTCTTCCTGT
ACAGCAAGCTGACCGTGGACAAGTCCCGGTGGCAGCAGGGCAACGTGTTCTCCTGCTC
CGTGATGCACGAGGCCCTGCACAACCACTACACCCAGAAGTCCCTGTCCCTGAGCCCC
GGCAAATGA

Figure 14(A)

anti-CD33 x C825 (based on hHIM34_VL3VH5)

*Light chain full amino acid sequence (N to C terminal)* [signal peptide-hHIM34 VL-3-CL-(G4S)$_3$ linker-mouse C825VH-(G4S)$_6$ linker-mouse C825VL] (SEQ ID NO: 26)

MGWSCIILFLVATATGVHSDIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGECTS*GGGGSG*
*GGGSGGGGS*HVKLQESGPGLVQPSQSLSLTCTVSGFSLTDYGVHWVRQSPGKGLEWLGVI
WSGGGTAYNTALISRLNIYRDNSKNQVFLEMNSLQAEDTAMYYCARRGSYPYNYFDAWG
CGTTVTVSS*GGGGSGGGGSGGGGSGGGGSGGGGSGGGGS*QAVVIQESALTTPPGETVTLTC
GSSTGAVTASNYANWVQEKPDHCFTGLIGGHNNRPPGVPARFSGSLIGDKAALTIAGTQTE
DEAIYFCALWYSDHWVIGGGTRLTVLG

*Heavy chain full amino acid sequence (N to C terminal)* [signal peptide-hHIM34 VH-5-CH1-3] (SEQ ID NO: 20)

MGWSCIILFLVATATGVHSQVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFN
WYVDGVEVHNAKTKPREEQYASTYRVVSVLTVLHQDWLNGKEYKCAVSNKALPAPIEKT
ISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

Figure 14(B)

anti-CD33 x huC825 (based on hHIM34_VL3VH5)

*Light chain full amino acid sequence (N to C terminal)* [signal peptide-hHIM34 VL-3-CL-(G4S)₃ linker-huC825VH-(G4S)₆ linker-huC825VL] (SEQ ID NO: 27)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGECTS*<u>GGGGSG</u>*
*<u>GGGSGGGGS</u>*HVQLVESGGGLVQPGGSLRLSCAASGFSLTDYGVHWVRQAPGKGLEWLGV
IWSGGGTAYNTALISRFTISRDNSKNTLYLQMNSLRAEDTAVYYCARRGSYPYNYFDAWG
CGTLVTVSS*<u>GGGGSGGGGSGGGGSGGGGSGGGGSGGGGS</u>*QAVVTQEPSLTVSPGGTVTLT
CGSSTGAVTASNYANWVQQKPGQCPRGLIGGHNNRPPGVPARFSGSLLGGKAALTLLGAQ
PEDEAEYYCALWYSDHWVIGGGTKLTVLG

*Heavy chain full amino acid sequence (N to C terminal)* [signal peptide-hHIM34 VH-5-CH1-3] (SEQ ID NO: 20)

<u>MGWSCIILFLVATATGVHS</u>QVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFN
WYVDGVEVHNAKTKPREEQYASTYRVVSVLTVLHQDWLNGKEYKCAVSNKALPAPIEKT
ISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

Figure 14(C)

anti-CD33 x C825 (based on hHIM34_VL3VH6)

*Light chain full amino acid sequence (N to C terminal)* [signal peptide-hHIM34 VL-3-CL-(G4S)$_3$ linker-mouse C825VH-(G4S)$_6$ linker-mouse C825VL] (SEQ ID NO: 26)

MGWSCIILFLVATATGVHSDIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGECTS*GGGGSG
GGGSGGGGS*HVKLQESGPGLVQPSQSLSLTCTVSGFSLTDYGVHWVRQSPGKGLEWLGVI
WSGGGTAYNTALISRLNIYRDNSKNQVFLEMNSLQAEDTAMYYCARRGSYPYNYFDAWG
CGTTVTVSS*GGGGSGGGGSGGGGSGGGGSGGGGSGGGGS*QAVVIQESALTTPPGETVTLTC
GSSTGAVTASNYANWVQEKPDHCFTGLIGGHNNRPPGVPARFSGSLIGDKAALTIAGTQTE
DEAIYFCALWYSDHWVIGGGTRLTVLG

*Heavy chain full amino acid sequence (N to C terminal)* [signal peptide-hHIM34 VH-6-CH1-3] (SEQ ID NO: 22)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFN
WYVDGVEVHNAKTKPREEQYASTYRVVSVLTVLHQDWLNGKEYKCAVSNKALPAPIEKT
ISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

Figure 14(D)

anti-CD33 x huC825 (based on hHIM34_VL3VH6)

*Light chain full amino acid sequence (N to C terminal)* [signal peptide-hHIM34 VL-3-CL-(G4S)$_3$ linker-huC825VH-(G4S)$_6$ linker-huC825VL] (SEQ ID NO: 27)

MGWSCIILFLVATATGVHSDIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGECTS*GGGGSG
GGGSGGGGS*HVQLVESGGGLVQPGGSLRLSCAASGFSLTDYGVHWVRQAPGKGLEWLGV
IWSGGGTAYNTALISRFTISRDNSKNTLYLQMNSLRAEDTAVYYCARRGSYPYNYFDAWG
CGTLVTVSS*GGGGSGGGGSGGGGSGGGGSGGGGSGGGGS*QAVVTQEPSLTVSPGGTVTLT
CGSSTGAVTASNYANWVQQKPGQCPRGLIGGHNNRPPGVPARFSGSLLGGKAALTLLGAQ
PEDEAEYYCALWYSDHWVIGGGTKLTVLG

*Heavy chain full amino acid sequence (N to C terminal)* [signal peptide-hHIM34 VH-6-CH1-3] (SEQ ID NO: 22)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFN
WYVDGVEVHNAKTKPREEQYASTYRVVSVLTVLHQDWLNGKEYKCAVSNKALPAPIEKT
ISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

Figure 14(E)

anti-CD33 x C825 (based on hHIM34_VL4VH6)

*Light chain full amino acid sequence (N to C terminal)* [signal peptide-hHIM34 VL-4-CL-(G4S)$_3$ linker-mouse C825VH-(G4S)$_6$ linker-mouse C825VL] (SEQ ID NO: 28)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKRTVAAPSVFIFPPSDEQLKSGTASVVCLLNNFYPREAKVQWKVDNALQSGNSQ
ESVTEQDSKDSTYSLSSTLTLSKADYEKHKVYACEVTHQGLSSPVTKSFNRGECTS*GGGGS
GGGGSGGGGS*HVKLQESGPGLVQPSQSLSLTCTVSGFSLTDYGVHWVRQSPGKGLEWLGV
IWSGGGTAYNTALISRLNIYRDNSKNQVFLEMNSLQAEDTAMYYCARRGSYPYNYFDAW
GCGTTVTVSS*GGGGSGGGGSGGGGSGGGGSGGGGSGGGGS*QAVVIQESALTTPPGETVTLT
CGSSTGAVTASNYANWVQEKPDHCFTGLIGGHNNRPPGVPARFSGSLIGDKAALTIAGTQT
EDEAIYFCALWYSDHWVIGGGTRLTVLG

*Heavy chain full amino acid sequence (N to C terminal)* [signal peptide-hHIM34 VH-6-CH1-3] (SEQ ID NO: 22)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFN
WYVDGVEVHNAKTKPREEQYASTYRVVSVLTVLHQDWLNGKEYKCAVSNKALPAPIEKT
ISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

Figure 14(F)

anti-CD33 x huC825 (based on hHIM34_VL4VH6)

*Light chain full amino acid sequence (N to C terminal)* [signal peptide-hHIM34 VL-4-CL-(G4S)₃ linker-huC825VH-(G4S)₆ linker-huC825VL] (SEQ ID NO: 29)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKRTVAAPSVFIFPPSDEQLKSGTASVVCLLNNFYPREAKVQWKVDNALQSGNSQ
ESVTEQDSKDSTYSLSSTLTLSKADYEKHKVYACEVTHQGLSSPVTKSFNRGECTS*GGGGS*
*GGGGSGGGGS*HVQLVESGGGLVQPGGSLRLSCAASGFSLTDYGVHWVRQAPGKGLEWLG
VIWSGGGTAYNTALISRFTISRDNSKNTLYLQMNSLRAEDTAVYYCARRGSYPYNYFDAW
GCGTLVTVSS*GGGGSGGGGSGGGGSGGGGSGGGGSGGGGS*QAVVTQEPSLTVSPGGTVTL
TCGSSTGAVTASNYANWVQQKPGQCPRGLIGGHNNRPPGVPARFSGSLLGGKAALTLLGA
QPEDEAEYYCALWYSDHWVIGGGTKLTVLG

*Heavy chain full amino acid sequence (N to C terminal)* [signal peptide-hHIM34 VH-6-CH1-3] (SEQ ID NO: 22)

<u>MGWSCIILFLVATATGVHS</u>QVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFN
WYVDGVEVHNAKTKPREEQYASTYRVVSVLTVLHQDWLNGKEYKCAVSNKALPAPIEKT
ISKAKGQPREPQVYTLPPSRDELTKNQVSLTCLVKGFYPSDIAVEWESNGQPENNYKTTPP
VLDSDGSFFLYSKLTVDKSRWQQGNVFSCSVMHEALHNHYTQKSLSLSPGK

Figure 14(G)

*Dota-engaging Bispecific antibody for radioimmunotherapy (based on murine HIM34):* anti-CD33 x C825 (CD33-HIM34 mouse VL-CL-(G4S)₃-mouse C825VH-(G4S)₆-mouse C825VL)
(SEQ ID NO: 138)

MGWSCIILFLVATATGVHSDIVMTQSPSSLSASLGGKVTITCKASQDINKYIAWYQHKP
GKGPRLLIHYTSTLQPGIPSRFSGSGSGRDYSFSISNLEPEDIATYYCLQYDNLLTFGAG
TKLELKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGECTS*GGGGSG*
*GGGSGGGG*SHVKLQESGPGLVQPSQSLSLTCTVSGFSLTDYGVHWVRQSPGKGLEWLGVI
WSGGGTAYNTALISRLNIYRDNSKNQVFLEMNSLQAEDTAMYYCARRGSYPYNYFDAWG
CGTTVTVSS*GGGGSGGGGSGGGGSGGGGSGGGGSGGGGS*QAVVIQESALTTPPGETVTLTC
GSSTGAVTASNYANWVQEKPDHCFTGLIGGHNNRPPGVPARFSGSLIGDKAALTIAGTQTE
DEAIYFCALWYSDHWVIGGGTRLTVLG

*Heavy chain full amino acid sequence (N to C terminal)* [signal peptide-HIM34 mouseVH-CH1-3]

(SEQ ID NO: 139)

MGWSCIILFLVATATGVHSEVKLQQSGPELVKPGTSVKVSCKASGYSFTDYNMYWVKQ
SHGKSLEWIGYIDPYKGGTIYNQKFKGKATLTVDKSSSTAFMHLNSLTSEDSAVYYCA
REMITAYYFDYWGQGSSVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKRVE
PKSCDKTHTCPPCPAPELLGGPSVFLFPPKPKDTLMISRTPEVTCVVVDVSHEDPEVKFNWY
VDGVEVHNAKTKPREEQYASTYRVVSVLTVLHQDWLNGKEYKCAVSNKALPAPIEKTISK
AKGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGK

Figure 14(H)

*anti-CD33 x huC825 (CD33-HIM34 mouse VL-CL-(G4S)₃-huC825VH-(G4S)₆-huC825VL)* (SEQ ID NO: 140)

MGWSCIILFLVATATGVHSDIVMTQSPSSLSASLGGKVTITCKASQDINKYIAWYQHKP
GKGPRLLIHYTSTLQPGIPSRFSGSGSGRDYSFSISNLEPEDIATYYCLQYDNLLTFGAG
TKLELKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGECTS*GGGGSG*
*GGGSGGGGS*HVQLVESGGGLVQPGGSLRLSCAASGFSLTDYGVHWVRQAPGKGLEWLGV
IWSGGGTAYNTALISRFTISRDNSKNTLYLQMNSLRAEDTAVYYCARRGSYPYNYFDAWG
CGTLVTVSS*GGGGSGGGGSGGGGSGGGGSGGGGSGGGGS*QAVVTQEPSLTVSPGGTVTLT
CGSSTGAVTASNYANWVQQKPGQCPRGLIGGHNNRPPGVPARFSGSLLGGKAALTLLGAQ
PEDEAEYYCALWYSDHWVIGGGTKLTVLG

*Heavy chain full amino acid sequence (N to C terminal)* [signal peptide-HIM34 mouseVH-CH1-3] (SEQ ID NO: 141)

MGWSCIILFLVATATGVHSEVKLQQSGPELVKPGTSVKVSCKASGYSFTDYNMYWVKQ
SHGKSLEWIGYIDPYKGGTIYNQKFKGKATLTVDKSSSTAFMHLNSLTSEDSAVYYCA
REMITAYYFDYWGQGSSVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKRVE
PKSCDKTHTCPPCPAPELLGGPSVFLFPPKPKDTLMISRTPEVTCVVVDVSHEDPEVKFNWY
VDGVEVHNAKTKPREEQYASTYRVVSVLTVLHQDWLNGKEYKCAVSNKALPAPIEKTISK
AKGQPREPQVYTLPPSRDELTKNQVSLTCLVKGFYPSDIAVEWESNGQPENNYKTTPPVLD
SDGSFFLYSKLTVDKSRWQQGNVFSCSVMHEALHNHYTQKSLSLSPGK

Figure 15(A)

hHIM34 VL3-(G4S)₆-hHIM34 VH5-(G4S)₄-hC825 VH-(G4S)₆-hC825 VL-spacer-linker-P53-spacer-H6 (SEQ ID NO: 30)

MGWSCIILFLVATATGVHSDIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVVKPGASVKV
SCKASGYSFTDYNMYWVRQAPGQGLEWMGYIDPYKGGTIYNQKFQGRATLTRDTSI
STAYMELSRLRSDDTAVYYCAREMITAYYFDYWGQGSSVTVSS*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGAPHHHHHH hHIM34 VL3-(G4S)₆-hHIM34 VH5-(G4S)₄-hC825 VH-(G4S)₆-hC825 VL-spacer-linker-P53-spacer (SEQ ID NO: 31)

MGWSCIILFLVATATGVHSDIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVVKPGASVKV
SCKASGYSFTDYNMYWVRQAPGQGLEWMGYIDPYKGGTIYNQKFQGRATLTRDTSI
STAYMELSRLRSDDTAVYYCAREMITAYYFDYWGQGSSVTVSS*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGA hHIM34 VH5-(G4S)₆-hHIM34 VL3-(G4S)₄-hC825 VH-(G4S)₆-hC825 VL-spacer-linker-P53-spacer-H6 (SEQ ID NO: 32)

MGWSCIILFLVATATGVHSQVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGAPHHHHHH

Figure 15(B)

hHIM34 VH5-(G4S)₆-hHIM34 VL3-(G4S)₄-hC825 VH-(G4S)₆-hC825 VL-spacer-linker-P53-spacer (SEQ ID NO: 33)

<u>MGWSCIILFLVATATGVHS</u>QVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGA hHIM34 VL3-(G4S)₆-hHIM34 VH5-(G4S)₄-hC825 VH-(G4S)₆-hC825 VL-spacer-linker-P63-spacer-H6 (SEQ ID NO: 34)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVVKPGASVKV
SCKASGYSFTDYNMYWVRQAPGQGLEWMGYIDPYKGGTIYNQKFQGRATLTRDTSI
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RSPDDELLYLPVRGRETYEMLLK
IKESLELMQYLPQHTIETYRQQQQQQHQHLLQKQ**GGSGGAPHHHHHH hHIM34 VL3-(G4S)₆-hHIM34 VH5-(G4S)₄-hC825 VH-(G4S)₆-hC825 VL-spacer-linker-P63-spacer (SEQ ID NO: 35)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVVKPGASVKV
SCKASGYSFTDYNMYWVRQAPGQGLEWMGYIDPYKGGTIYNQKFQGRATLTRDTSI
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RSPDDELLYLPVRGRETYEMLLK
IKESLELMQYLPQHTIETYRQQQQQQHQHLLQKQ**GGSGGA

Figure 15(C)

hHIM34 VH5-(G4S)₆-hHIM34 VL3-(G4S)₄-hC825 VH-(G4S)₆-hC825 VL-spacer-linker-P63-spacer-H6 (SEQ ID NO: 36)

MGWSCIILFLVATATGVHSQVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RSPDDELLYLPVRGRETYEMLLK
IKESLELMQYLPQHTIETYRQQQQQQHQHLLQKQ**GGSGGAPHHHHHH hHIM34 VH5-(G4S)₆-hHIM34 VL3-(G4S)₄-hC825 VH-(G4S)₆-hC825 VL-spacer-linker-P63-spacer (SEQ ID NO: 37)

MGWSCIILFLVATATGVHSQVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RSPDDELLYLPVRGRETYEMLLK
IKESLELMQYLPQHTIETYRQQQQQQHQHLLQKQ**GGSGGA hHIM34 VL3-(G4S)₆-hHIM34 VH5-(G4S)₄-hC825 VH-(G4S)₆-hC825 VL-spacer-linker-P73-spacer-H6 (SEQ ID NO: 38)

MGWSCIILFLVATATGVHSDIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVVKPGASVKV
SCKASGYSFTDYNMYWVRQAPGQGLEWMGYIDPYKGGTIYNQKFQGRATLTRDTSI
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGAPHHHHHH

Figure 15(D)

hHIM34 VL3-(G4S)₆-hHIM34 VH5-(G4S)₄-hC825 VH-(G4S)₆-hC825 VL-spacer-linker-P73-spacer (SEQ ID NO: 39)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVVKPGASVKV
SCKASGYSFTDYNMYWVRQAPGQGLEWMGYIDPYKGGTIYNQKFQGRATLTRDTSI
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGA hHIM34 VH5-(G4S)₆-hHIM34 VL3-(G4S)₄-hC825 VH-(G4S)₆-hC825 VL-spacer-linker-P73-spacer-H6 (SEQ ID NO: 40)

<u>MGWSCIILFLVATATGVHS</u>QVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGAPHHHHHH hHIM34 VH5-(G4S)₆-hHIM34 VL3-(G4S)₄-hC825 VH-(G4S)₆-hC825 VL-spacer-linker-P73-spacer (SEQ ID NO: 41)

<u>MGWSCIILFLVATATGVHS</u>QVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGA

Figure 15(E)

hHIM34 VL3-(G4S)₆-hHIM34 VH6-(G4S)₄-hC825 VH-(G4S)₆-hC825 VL-spacer-linker-P53-spacer-H6 (SEQ ID NO: 42)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVKKPGASVKV
SCKASGYSFTDYNMYWVRQAPGQGLEWMGYIDPYKGGTIYNQKFKGRATLTRDTSI
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGAPHHHHHH hHIM34 VL3-(G4S)₆-hHIM34 VH6-(G4S)₄-hC825 VH-(G4S)₆-hC825 VL-spacer-linker-P53-spacer (SEQ ID NO: 43)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVKKPGASVKV
SCKASGYSFTDYNMYWVRQAPGQGLEWMGYIDPYKGGTIYNQKFKGRATLTRDTSI
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSSGGGGSGGGGSGGGGSGGGGSGGGGSGGGGSQAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLGTPLGDTTHTSG**KPLDGEYFTLQIRGRERFEMFR
ELNEALELKDAQAGKEP**GGSGGA hHIM34 VH6-(G4S)₆-hHIM34 VL3-(G4S)₄-hC825 VH-(G4S)₆-hC825 VL-spacer-linker-P53-spacer-H6 (SEQ ID NO: 44)

<u>MGWSCIILFLVATATGVHS</u>QVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGAPHHHHHH

Figure 15(F)

hHIM34 VH6-(G4S)₆-hHIM34 VL3-(G4S)₄-hC825 VH-(G4S)₆-hC825 VL-spacer-linker-P53-spacer (SEQ ID NO: 45)

<u>MGWSCIILFLVATATGVHS</u>QVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGA hHIM34 VL3-(G4S)₆-hHIM34 VH6-(G4S)₄-hC825 VH-(G4S)₆-hC825 VL-spacer-linker-P63-spacer-H6 (SEQ ID NO: 46)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVKKPGASVKV
SCKASGYSFTDYNMYWVRQAPGQGLEWMGYIDPYKGGTIYNQKFKGRATLTRDTSI
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RSPDDELLYLPVRGRETYEMLLK
IKESLELMQYLPQHTIETYRQQQQQQHQHLLQKQ**GGSGGAPHHHHHH hHIM34 VL3-(G4S)₆-hHIM34 VH6-(G4S)₄-hC825 VH-(G4S)₆-hC825 VL-spacer-linker-P63-spacer (SEQ ID NO: 47)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVKKPGASVKV
SCKASGYSFTDYNMYWVRQAPGQGLEWMGYIDPYKGGTIYNQKFKGRATLTRDTSI
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RSPDDELLYLPVRGRETYEMLLK
IKESLELMQYLPQHTIETYRQQQQQQHQHLLQKQ**GGSGGA

Figure 15(G)

hHIM34 VH6-(G4S)₆-hHIM34 VL3-(G4S)₄-hC825 VH-(G4S)₆-hC825 VL-spacer-linker-P63-spacer-H6 (SEQ ID NO: 48)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RSPDDELLYLPVRGRETYEMLLK
IKESLELMQYLPQHTIETYRQQQQQQHQHLLQKQ**GGSGGAPHHHHHH hHIM34 VH6-(G4S)₆-hHIM34 VL3-(G4S)₄-hC825 VH-(G4S)₆-hC825 VL-spacer-linker-P63-spacer (SEQ ID NO: 49)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFSGSGS
GTDFTFTISSLQPEDIATYYCLQYDNLLTFGAGTKLELKR*GGGGSGGGGSGGGGSGGGGS*H
VQLVESGGGLVQPGGSLRLSCAASGFSLTDYGVHWVRQAPGKGLEWLGVIWSGGGTAYN
TALISRFTISRDNSKNTLYLQMNSLRAEDTAVYYCARRGSYPYNYFDAWGCGTLVTVSS*G
GGGSGGGGSGGGGSGGGGSGGGGSGGGGS*QAVVTQEPSLTVSPGGTVTLTCGSSTGAVTA
SNYANWVQQKPGQCPRGLIGGHNNRPPGVPARFSGSLLGGKAALTLLGAQPEDEAEYYCA
LWYSDHWVIGGGTKLTVLG*TPLGDTTHT*SG**RSPDDELLYLPVRGRETYEMLLKIKESLE
LMQYLPQHTIETYRQQQQQQHQHLLQKQ**GGSGGA hHIM34 VL3-(G4S)₆-hHIM34 VH6-(G4S)₄-hC825 VH-(G4S)₆-hC825 VL-spacer-linker-P73-spacer-H6 (SEQ ID NO: 50)

MGWSCIILFLVATATGVHSDIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVKKPGASVKV
SCKASGYSFTDYNMYWVRQAPGQGLEWMGYIDPYKGGTIYNQKFKGRATLTRDTSI
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGAPHHHHHH

Figure 15(H)

hHIM34 VL3-(G4S)₆-hHIM34 VH6-(G4S)₄-hC825 VH-(G4S)₆-hC825 VL-spacer-linker-P73-spacer (SEQ ID NO: 51)

MGWSCIILFLVATATGVHSDIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLQQSGAEVKKPGASVKV
SCKASGYSFTDYNMYWVRQAPGQGLEWMGYIDPYKGGTIYNQKFKGRATLTRDTSI
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGA hHIM34 VH6-(G4S)₆-hHIM34 VL3-(G4S)₄-hC825 VH-(G4S)₆-hC825 VL-spacer-linker-P73-spacer-H6 (SEQ ID NO: 52)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGAPHHHHHH hHIM34 VH6-(G4S)₆-hHIM34 VL3-(G4S)₄-hC825 VH-(G4S)₆-hC825 VL-spacer-linker-P73-spacer (SEQ ID NO: 53)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGA

Figure 15(I)

hHIM34 VL4-(G4S)₆-hHIM34 VH6-(G4S)₄-hC825 VH-(G4S)₆-hC825 VL-spacer-linker-P53-spacer-H6 (SEQ ID NO: 54)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVKKPGASVK
VSCKASGYSFTDYNMYWVRQAPGQGLEWMGYIDPYKGGTIYNQKFKGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**KPLDGEYFTLQIRGRERFEMFR
ELNEALELKDAQAGKEP**GGSGGAPHHHHHH hHIM34 VL4-(G4S)₆-hHIM34 VH6-(G4S)₄-hC825 VH-(G4S)₆-hC825 VL-spacer-linker-P53-spacer (SEQ ID NO: 55)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVKKPGASVK
VSCKASGYSFTDYNMYWVRQAPGQGLEWMGYIDPYKGGTIYNQKFKGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**KPLDGEYFTLQIRGRERFEMFR
ELNEALELKDAQAGKEP**GGSGGA hHIM34 VH6-(G4S)₆-hHIM34 VL4-(G4S)₄-hC825 VH-(G4S)₆-hC825 VL-spacer-linker-P53-spacer-H6 (SEQ ID NO: 56)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGAPHHHHHH

Figure 15(J)

hHIM34 VH6-(G4S)₆-hHIM34 VL4-(G4S)₄-hC825 VH-(G4S)₆-hC825 VL-spacer-linker-P53-spacer (SEQ ID NO: 57)

<u>MGWSCIILFLVATATGVHS</u>QVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGA hHIM34 VL4-(G4S)₆-hHIM34 VH6-(G4S)₄-hC825 VH-(G4S)₆-hC825 VL-spacer-linker-P63-spacer-H6 (SEQ ID NO: 58)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVKKPGASVK
VSCKASGYSFTDYNMYWVRQAPGQGLEWMGYIDPYKGGTIYNQKFKGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SGR**SPDDELLYLPVRGRETYEMLL
KIKESLELMQYLPQHTIETYRQQQQQQHQHLLQKQ**GGSGGAPHHHHHH hHIM34 VL4-(G4S)₆-hHIM34 VH6-(G4S)₄-hC825 VH-(G4S)₆-hC825 VL-spacer-linker-P63-spacer (SEQ ID NO: 59)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVKKPGASVK
VSCKASGYSFTDYNMYWVRQAPGQGLEWMGYIDPYKGGTIYNQKFKGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SGR**SPDDELLYLPVRGRETYEMLL
KIKESLELMQYLPQHTIETYRQQQQQQHQHLLQKQ**GGSGGA

Figure 15(K)

hHIM34 VH6-(G4S)₆-hHIM34 VL4-(G4S)₄-hC825 VH-(G4S)₆-hC825 VL-spacer-linker-P63-spacer-H6 (SEQ ID NO: 60)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SGRSPDDELLYLPVRGRETYEMLLK
IKESLELMQYLPQHTIETYRQQQQQQHQHLLQKQGGSGGAPHHHHHH hHIM34 VH6-(G4S)₆-hHIM34 VL4-(G4S)₄-hC825 VH-(G4S)₆-hC825 VL-spacer-linker-P63-spacer (SEQ ID NO: 61)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SGRSPDDELLYLPVRGRETYEMLLK
IKESLELMQYLPQHTIETYRQQQQQQHQHLLQKQGGSGGA hHIM34 VL4-(G4S)₆-hHIM34 VH6-(G4S)₄-hC825 VH-(G4S)₆-hC825 VL-spacer-linker-P73-spacer-H6 (SEQ ID NO: 62)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVKKPGASVK
VSCKASGYSFTDYNMYWVRQAPGQGLEWMGYIDPYKGGTIYNQKFKGRATLTRDTS
ISTAYMELSRLRSDDTAVYYCAREMITAYYFDYWGQGSSVTVSS*GGGGSGGGGSGGGG*
*SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SGRHGDEDTYYLQVRGRENFEIL
MKLKESLELMELVPQPLVDSYRQQQQLLQRPGGSGGAPHHHHHH

Figure 15(L)

hHIM34 VL4-(G4S)₆-hHIM34 VH6-(G4S)₄-hC825 VH-(G4S)₆-hC825 VL-spacer-linker-P73-spacer (SEQ ID NO: 63)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVKKPGASVK
VSCKASGYSFTDYNMYWVRQAPGQGLEWMGYIDPYKGGTIYNQKFKGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**RHGDEDTYYLQVRGRENFEIL
MKLKESLELMELVPQPLVDSYRQQQQLLQRP**GGSGGA hHIM34 VH6-(G4S)₆-hHIM34 VL4-(G4S)₄-hC825 VH-(G4S)₆-hC825 VL-spacer-linker-P73-spacer-H6 (SEQ ID NO: 64)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGAPHHHHHH hHIM34 VH6-(G4S)₆-hHIM34 VL4-(G4S)₄-hC825 VH-(G4S)₆-hC825 VL-spacer-linker-P73-spacer (SEQ ID NO: 65)

MGWSCIILFLVATATGVHSQVQLQQSGAEVKKPGASVKVSCKASGYSFTDYNMYWVR
QAPGQGLEWMGYIDPYKGGTIYNQKFKGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGA

Figure 15(M)

hHIM34 VL4-(G4S)₆-hHIM34 VH4-(G4S)₄-hC825 VH-(G4S)₆-hC825 VL-spacer-linker-P53-spacer-H6 (SEQ ID NO: 66)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLVQSGAEVKKPGASVK
VSCKASGYSFTDYNMYWVRQAPGQGLEWIGYIDPYKGGTNYAQKFQGRATLTVDKS
SSTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**KPLDGEYFTLQIRGRERFEMFR
ELNEALELKDAQAGKEP**GGSGGAPHHHHHH hHIM34 VL4-(G4S)₆-hHIM34 VH4-(G4S)₄-hC825 VH-(G4S)₆-hC825 VL-spacer-linker-P53-spacer (SEQ ID NO: 67)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLVQSGAEVKKPGASVK
VSCKASGYSFTDYNMYWVRQAPGQGLEWIGYIDPYKGGTNYAQKFQGRATLTVDKS
SSTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**KPLDGEYFTLQIRGRERFEMFR
ELNEALELKDAQAGKEP**GGSGGA hHIM34 VH4-(G4S)₆-hHIM34 VL4-(G4S)₄-hC825 VH-(G4S)₆-hC825 VL-spacer-linker-P53-spacer-H6 (SEQ ID NO: 68)

<u>MGWSCIILFLVATATGVHS</u>QVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGAPHHHHHH

Figure 15(N)

hHIM34 VH4-(G4S)₆-hHIM34 VL4-(G4S)₄-hC825 VH-(G4S)₆-hC825 VL-spacer-linker-P53-spacer (SEQ ID NO: 69)

MGWSCIILFLVATATGVHSQVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGA hHIM34 VL4-(G4S)₆-hHIM34 VH4-(G4S)₄-hC825 VH-(G4S)₆-hC825 VL-spacer-linker-P63-spacer-H6 (SEQ ID NO: 70)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLVQSGAEVKKPGASVK
VSCKASGYSFTDYNMYWVRQAPGQGLEWIGYIDPYKGGTNYAQKFQGRATLTVDKS
SSTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**RSPDDELLYLPVRGRETYEMLL
KIKESLELMQYLPQHTIETYRQQQQQQHQHLLQKQ**GGSGGAPHHHHHH hHIM34 VL4-(G4S)₆-hHIM34 VH4-(G4S)₄-hC825 VH-(G4S)₆-hC825 VL-spacer-linker-P63-spacer (SEQ ID NO: 71)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLVQSGAEVKKPGASVK
VSCKASGYSFTDYNMYWVRQAPGQGLEWIGYIDPYKGGTNYAQKFQGRATLTVDKS
SSTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**RSPDDELLYLPVRGRETYEMLL
KIKESLELMQYLPQHTIETYRQQQQQQHQHLLQKQ**GGSGGA

Figure 15(O)

hHIM34 VH4-(G4S)₆-hHIM34 VL4-(G4S)₄-hC825 VH-(G4S)₆-hC825 VL-spacer-linker-P63-spacer-H6 (SEQ ID NO: 72)

<u>MGWSCIILFLVATATGVHS</u>QVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG<u>RSPDDELLYLPVRGRETYEMLLK
IKESLELMQYLPQHTIETYRQQQQQQHQHLLQKQ</u>GGSGGAPHHHHHH hHIM34 VH4-(G4S)₆-hHIM34 VL4-(G4S)₄-hC825 VH-(G4S)₆-hC825 VL-spacer-linker-P63-spacer (SEQ ID NO: 73)

<u>MGWSCIILFLVATATGVHS</u>QVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG<u>RSPDDELLYLPVRGRETYEMLLK
IKESLELMQYLPQHTIETYRQQQQQQHQHLLQKQ</u>GGSGGA hHIM34 VL4-(G4S)₆-hHIM34 VH4-(G4S)₄-hC825 VH-(G4S)₆-hC825 VL-spacer-linker-P73-spacer-H6 (SEQ ID NO: 74)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLVQSGAEVKKPGASVK
VSCKASGYSFTDYNMYWVRQAPGQGLEWIGYIDPYKGGTNYAQKFQGRATLTVDKS
SSTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG<u>RHGDEDTYYLQVRGRENFEIL
MKLKESLELMELVPQPLVDSYRQQQQLLQRP</u>GGSGGAPHHHHHH

Figure 15(P)

hHIM34 VL4-(G4S)₆-hHIM34 VH4-(G4S)₄-hC825 VH-(G4S)₆-hC825 VL-spacer-linker-P73-spacer (SEQ ID NO: 75)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLVQSGAEVKKPGASVK
VSCKASGYSFTDYNMYWVRQAPGQGLEWIGYIDPYKGGTNYAQKFQGRATLTVDKS
SSTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**RHGDEDTYYLQVRGRENFEIL
MKLKESLELMELVPQPLVDSYRQQQQLLQRP**GGSGGA hHIM34 VH4-(G4S)₆-hHIM34 VL4-(G4S)₄-hC825 VH-(G4S)₆-hC825 VL-spacer-linker-P73-spacer-H6 (SEQ ID NO: 76)

MGWSCIILFLVATATGVHSQVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGAPHHHHHH hHIM34 VH4-(G4S)₆-hHIM34 VL4-(G4S)₄-hC825 VH-(G4S)₆-hC825 VL-spacer-linker-P73-spacer (SEQ ID NO: 77)

MGWSCIILFLVATATGVHSQVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGA

Figure 15(Q)

hHIM34 VL4-(G4S)₆-hHIM34 VH1-(G4S)₄-hC825 VH-(G4S)₆-hC825 VL-spacer-linker-P53-spacer-H6 (SEQ ID NO: 78)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWIGYIDPYKGGTNYAQKFQGRVTMTVDK
SSSTAYMELSRLRSDDTAVYYCAREMITAYYFDYWGQGSSVTVSS*GGGGSGGGGSGGG
GSGGGGS*HVQLVESGGGLVQPGGSLRLSCAASGFSLTDYGVHWVRQAPGKGLEWLGVIW
SGGGTAYNTALISRFTISRDNSKNTLYLQMNSLRAEDTAVYYCARRGSYPYNYFDAWGCG
TLVTVSS*GGGGSGGGGSGGGGSGGGGSGGGGSGGGGS*QAVVTQEPSLTVSPGGTVTLTCG
SSTGAVTASNYANWVQQKPGQCPRGLIGGHNNRPPGVPARFSGSLLGGKAALTLLGAQPE
DEAEYYCALWYSDHWVIGGGTKLTVLG*TPLGDTTHT*SG**KPLDGEYFTLQIRGRERFEMF
RELNEALELKDAQAGKEP**GGSGGAPHHHHHH hHIM34 VL4-(G4S)₆-hHIM34 VH1-(G4S)₄-hC825 VH-(G4S)₆-hC825 VL-spacer-linker-P53-spacer (SEQ ID NO: 79)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWIGYIDPYKGGTNYAQKFQGRVTMTVDK
SSSTAYMELSRLRSDDTAVYYCAREMITAYYFDYWGQGSSVTVSS*GGGGSGGGGSGGG
GSGGGGS*HVQLVESGGGLVQPGGSLRLSCAASGFSLTDYGVHWVRQAPGKGLEWLGVIW
SGGGTAYNTALISRFTISRDNSKNTLYLQMNSLRAEDTAVYYCARRGSYPYNYFDAWGCG
TLVTVSS*GGGGSGGGGSGGGGSGGGGSGGGGSGGGGS*QAVVTQEPSLTVSPGGTVTLTCG
SSTGAVTASNYANWVQQKPGQCPRGLIGGHNNRPPGVPARFSGSLLGGKAALTLLGAQPE
DEAEYYCALWYSDHWVIGGGTKLTVLG*TPLGDTTHT*SG**KPLDGEYFTLQIRGRERFEMF
RELNEALELKDAQAGKEP**GGSGGA hHIM34 VH1-(G4S)₆-hHIM34 VL4-(G4S)₄-hC825 VH-(G4S)₆-hC825 VL-spacer-linker-P53-spacer-H6 (SEQ ID NO: 80)

MGWSCIILFLVATATGVHSQVQLQQSGAEVVKPGASVKVSCKASGYSFTDYNMYWVR
QAPGQGLEWIGYIDPYKGGTNYAQKFQGRVTMTVDKSSSTAYMELSRLRSDDTAVY
YCAREMITAYYFDYWGQGSSVTVSS*GGGGSGGGGSGGGGSGGGGSGGGGSGGGGS*DIQ
MTQSPSSLSASVGDRVTITCKASQDINKYIAWYQHKPGKAPKLLIYYASNLQPGVPSRF
SGSGSGRDFTFTISSLQPEDIATYYCLQYDNLLTFGAGTKLELKR*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**KPLDGEYFTLQIRGRERFEMFR
ELNEALELKDAQAGKEP**GGSGGAPHHHHHH

Figure 15(R)

hHIM34 VH1-(G4S)₆-hHIM34 VL4-(G4S)₄-hC825 VH-(G4S)₆-hC825 VL-spacer-linker-P53-spacer (SEQ ID NO: 81)

<u>MGWSCIILFLVATATGVHS</u>QVQLQQSGAEVVKPGASVKVSCKASGYSFTDYNMYWVR
QAPGQGLEWIGYIDPYKGGTNYAQKFQGRVTMTVDKSSSTAYMELSRLRSDDTAVY
YCAREMITAYYFDYWGQGSSVTVSS*GGGGSGGGGSGGGGSGGGGSGGGGSGGGGS*DIQ
MTQSPSSLSASVGDRVTITCKASQDINKYIAWYQHKPGKAPKLLIYYASNLQPGVPSRF
SGSGSGRDFTFTISSLQPEDIATYYCLQYDNLLTFGAGTKLELKR*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**KPLDGEYFTLQIRGRERFEMFR
ELNEALELKDAQAGKEP**GGSGGA hHIM34 VL4-(G4S)₆-hHIM34 VH1-(G4S)₄-hC825 VH-(G4S)₆-hC825 VL-spacer-linker-P63-spacer-H6 (SEQ ID NO: 82)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWIGYIDPYKGGTNYAQKFQGRVTMTVDK
SSSTAYMELSRLRSDDTAVYYCAREMITAYYFDYWGQGSSVTVSS*GGGGSGGGGSGGG
GSGGGGS*HVQLVESGGGLVQPGGSLRLSCAASGFSLTDYGVHWVRQAPGKGLEWLGVIW
SGGGTAYNTALISRFTISRDNSKNTLYLQMNSLRAEDTAVYYCARRGSYPYNYFDAWGCG
TLVTVSS*GGGGSGGGGSGGGGSGGGGSGGGGSGGGGS*QAVVTQEPSLTVSPGGTVTLTCG
SSTGAVTASNYANWVQQKPGQCPRGLIGGHNNRPPGVPARFSGSLLGGKAALTLLGAQPE
DEAEYYCALWYSDHWVIGGGTKLTVLG*TPLGDTTHT*SG**RSPDDELLYLPVRGRETYEML
LKIKESLELMQYLPQHTIETYRQQQQQQHQHLLQKQ**GGSGGAPHHHHHH hHIM34 VL4-(G4S)₆-hHIM34 VH1-(G4S)₄-hC825 VH-(G4S)₆-hC825 VL-spacer-linker-P63-spacer (SEQ ID NO: 83)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWIGYIDPYKGGTNYAQKFQGRVTMTVDK
SSSTAYMELSRLRSDDTAVYYCAREMITAYYFDYWGQGSSVTVSS*GGGGSGGGGSGGG
GSGGGGS*HVQLVESGGGLVQPGGSLRLSCAASGFSLTDYGVHWVRQAPGKGLEWLGVIW
SGGGTAYNTALISRFTISRDNSKNTLYLQMNSLRAEDTAVYYCARRGSYPYNYFDAWGCG
TLVTVSS*GGGGSGGGGSGGGGSGGGGSGGGGSGGGGS*QAVVTQEPSLTVSPGGTVTLTCG
SSTGAVTASNYANWVQQKPGQCPRGLIGGHNNRPPGVPARFSGSLLGGKAALTLLGAQPE
DEAEYYCALWYSDHWVIGGGTKLTVLG*TPLGDTTHT*SG**RSPDDELLYLPVRGRETYEML
LKIKESLELMQYLPQHTIETYRQQQQQQHQHLLQKQ**GGSGGA

Figure 15(S)

hHIM34 VH1-(G4S)₆-hHIM34 VL4-(G4S)₄-hC825 VH-(G4S)₆-hC825 VL-spacer-linker-P63-spacer-H6 (SEQ ID NO: 84)

<u>MGWSCIILFLVATATGVHS</u>QVQLQQSGAEVVKPGASVKVSCKASGYSFTDYNMYWVR
QAPGQGLEWIGYIDPYKGGTNYAQKFQGRVTMTVDKSSSTAYMELSRLRSDDTAVY
YCAREMITAYYFDYWGQGSSVTVSS*GGGGSGGGGSGGGGSGGGGSGGGGSGGGGS*DIQ
MTQSPSSLSASVGDRVTITCKASQDINKYIAWYQHKPGKAPKLLIYYASNLQPGVPSRF
SGSGSGRDFTFTISSLQPEDIATYYCLQYDNLLTFGAGTKLELKR*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SGR**SPDDELLYLPVRGRETYEMLL
KIKESLELMQYLPQHTIETYRQQQQQQHQHLLQKQ**GGSGGAPHHHHHH hHIM34 VH1-(G4S)₆-hHIM34 VL4-(G4S)₄-hC825 VH-(G4S)₆-hC825 VL-spacer-linker-P63-spacer (SEQ ID NO: 85)

<u>MGWSCIILFLVATATGVHS</u>QVQLQQSGAEVVKPGASVKVSCKASGYSFTDYNMYWVR
QAPGQGLEWIGYIDPYKGGTNYAQKFQGRVTMTVDKSSSTAYMELSRLRSDDTAVY
YCAREMITAYYFDYWGQGSSVTVSS*GGGGSGGGGSGGGGSGGGGSGGGGSGGGGS*DIQ
MTQSPSSLSASVGDRVTITCKASQDINKYIAWYQHKPGKAPKLLIYYASNLQPGVPSRF
SGSGSGRDFTFTISSLQPEDIATYYCLQYDNLLTFGAGTKLELKR*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SGR**SPDDELLYLPVRGRETYEMLL
KIKESLELMQYLPQHTIETYRQQQQQQHQHLLQKQ**GGSGGA hHIM34 VL4-(G4S)₆-hHIM34 VH1-(G4S)₄-hC825 VH-(G4S)₆-hC825 VL-spacer-linker-P73-spacer-H6 (SEQ ID NO: 86)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWIGYIDPYKGGTNYAQKFQGRVTMTVDK
SSSTAYMELSRLRSDDTAVYYCAREMITAYYFDYWGQGSSVTVSS*GGGGSGGGGSGGG
GSGGGGS*HVQLVESGGGLVQPGGSLRLSCAASGFSLTDYGVHWVRQAPGKGLEWLGVIW
SGGGTAYNTALISRFTISRDNSKNTLYLQMNSLRAEDTAVYYCARRGSYPYNYFDAWGCG
TLVTVSS*GGGGSGGGGSGGGGSGGGGSGGGGSGGGGS*QAVVTQEPSLTVSPGGTVTLTCG
SSTGAVTASNYANWVQQKPGQCPRGLIGGHNNRPPGVPARFSGSLLGGKAALTLLGAQPE
DEAEYYCALWYSDHWVIGGGTKLTVLG*TPLGDTTHT*SGR**HGDEDTYYLQVRGRENFEIL
MKLKESLELMELVPQPLVDSYRQQQQLLQRP**GGSGGAPHHHHHH

Figure 15(T)

hHIM34 VL4-(G4S)₆-hHIM34 VH1-(G4S)₄-hC825 VH-(G4S)₆-hC825 VL-spacer-linker-P73-spacer (SEQ ID NO: 87)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWIGYIDPYKGGTNYAQKFQGRVTMTVDK
SSSTAYMELSRLRSDDTAVYYCAREMITAYYFDYWGQGSSVTVSS*GGGGSGGGGSGGG
GSGGGGS*HVQLVESGGGLVQPGGSLRLSCAASGFSLTDYGVHWVRQAPGKGLEWLGVIW
SGGGTAYNTALISRFTISRDNSKNTLYLQMNSLRAEDTAVYYCARRGSYPYNYFDAWGCG
TLVTVSS*GGGGSGGGGSGGGGSGGGGSGGGGSGGGGS*QAVVTQEPSLTVSPGGTVTLTCG
SSTGAVTASNYANWVQQKPGQCPRGLIGGHNNRPPGVPARFSGSLLGGKAALTLLGAQPE
DEAEYYCALWYSDHWVIGGGTKLTVLG*TPLGDTTHT*SG**RHGDEDTYYLQVRGRENFEIL
MKLKESLELMELVPQPLVDSYRQQQQLLQRP**GGSGGA hHIM34 VH1-(G4S)₆-hHIM34 VL4-(G4S)₄-hC825 VH-(G4S)₆-hC825 VL-spacer-linker-P73-spacer-H6 (SEQ ID NO: 88)

<u>MGWSCIILFLVATATGVHS</u>QVQLQQSGAEVVKPGASVKVSCKASGYSFTDYNMYWVR
QAPGQGLEWIGYIDPYKGGTNYAQKFQGRVTMTVDKSSSTAYMELSRLRSDDTAVY
YCAREMITAYYFDYWGQGSSVTVSS*GGGGSGGGGSGGGGSGGGGSGGGGSGGGGS*DIQ
MTQSPSSLSASVGDRVTITCKASQDINKYIAWYQHKPGKAPKLLIYYASNLQPGVPSRF
SGSGSGRDFTFTISSLQPEDIATYYCLQYDNLLTFGAGTKLELKR*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**RHGDEDTYYLQVRGRENFEIL
MKLKESLELMELVPQPLVDSYRQQQQLLQRP**GGSGGAPHHHHHH hHIM34 VH1-(G4S)₆-hHIM34 VL4-(G4S)₄-hC825 VH-(G4S)₆-hC825 VL-spacer-linker-P73-spacer (SEQ ID NO: 89)

<u>MGWSCIILFLVATATGVHS</u>QVQLQQSGAEVVKPGASVKVSCKASGYSFTDYNMYWVR
QAPGQGLEWIGYIDPYKGGTNYAQKFQGRVTMTVDKSSSTAYMELSRLRSDDTAVY
YCAREMITAYYFDYWGQGSSVTVSS*GGGGSGGGGSGGGGSGGGGSGGGGSGGGGS*DIQ
MTQSPSSLSASVGDRVTITCKASQDINKYIAWYQHKPGKAPKLLIYYASNLQPGVPSRF
SGSGSGRDFTFTISSLQPEDIATYYCLQYDNLLTFGAGTKLELKR*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**RHGDEDTYYLQVRGRENFEIL
MKLKESLELMELVPQPLVDSYRQQQQLLQRP**GGSGGA

Figure 15(U)

hHIM34 VL4-(G4S)₆-hHIM34 VH5-(G4S)₄-hC825 VH-(G4S)₆-hC825 VL-spacer-linker-P53-spacer-H6 (SEQ ID NO: 90)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWMGYIDPYKGGTIYNQKFQGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**KPLDGEYFTLQIRGRERFEMFR
ELNEALELKDAQAGKEP**GGSGGAPHHHHHH hHIM34 VL4-(G4S)₆-hHIM34 VH5-(G4S)₄-hC825 VH-(G4S)₆-hC825 VL-spacer-linker-P53-spacer (SEQ ID NO: 91)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWMGYIDPYKGGTIYNQKFQGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**KPLDGEYFTLQIRGRERFEMFR
ELNEALELKDAQAGKEP**GGSGGA hHIM34 VH5-(G4S)₆-hHIM34 VL4-(G4S)₄-hC825 VH-(G4S)₆-hC825 VL-spacer-linker-P53-spacer-H6 (SEQ ID NO: 92)

MGWSCIILFLVATATGVHSQVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGAPHHHHHH

Figure 15(V)

hHIM34 VH5-(G4S)₆-hHIM34 VL4-(G4S)₄-hC825 VH-(G4S)₆-hC825 VL-spacer-linker-P53-spacer (SEQ ID NO: 93)

MGWSCIILFLVATATGVHSQVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGA hHIM34 VL4-(G4S)₆-hHIM34 VH5-(G4S)₄-hC825 VH-(G4S)₆-hC825 VL-spacer-linker-P63-spacer-H6 (SEQ ID NO: 94)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWMGYIDPYKGGTIYNQKFQGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**RSPDDELLYLPVRGRETYEMLL
KIKESLELMQYLPQHTIETYRQQQQQQHQHLLQKQ**GGSGGAPHHHHHH hHIM34 VL4-(G4S)₆-hHIM34 VH5-(G4S)₄-hC825 VH-(G4S)₆-hC825 VL-spacer-linker-P63-spacer (SEQ ID NO: 95)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWMGYIDPYKGGTIYNQKFQGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**RSPDDELLYLPVRGRETYEMLL
KIKESLELMQYLPQHTIETYRQQQQQQHQHLLQKQ**GGSGGA

Figure 15(W)

hHIM34 VH5-(G4S)$_6$-hHIM34 VL4-(G4S)$_4$-hC825 VH-(G4S)$_6$-hC825 VL-spacer-linker-P63-spacer-H6 (SEQ ID NO: 96)

<u>MGWSCIILFLVATATGVHS</u>QVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RSPDDELLYLPVRGRETYEMLLK
IKESLELMQYLPQHTIETYRQQQQQQHQHLLQKQ**GGSGGAPHHHHHH hHIM34 VH5-(G4S)$_6$-hHIM34 VL4-(G4S)$_4$-hC825 VH-(G4S)$_6$-hC825 VL-spacer-linker-P63-spacer (SEQ ID NO: 97)

<u>MGWSCIILFLVATATGVHS</u>QVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RSPDDELLYLPVRGRETYEMLLK
IKESLELMQYLPQHTIETYRQQQQQQHQHLLQKQ**GGSGGA hHIM34 VL4-(G4S)$_6$-hHIM34 VH5-(G4S)$_4$-hC825 VH-(G4S)$_6$-hC825 VL-spacer-linker-P73-spacer-H6 (SEQ ID NO: 98)

<u>MGWSCIILFLVATATGVHS</u>DIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWMGYIDPYKGGTIYNQKFQGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SG**RHGDEDTYYLQVRGRENFEIL
MKLKESLELMELVPQPLVDSYRQQQQLLQRP**GGSGGAPHHHHHH

Figure 15(X)

hHIM34 VL4-(G4S)₆-hHIM34 VH5-(G4S)₄-hC825 VH-(G4S)₆-hC825 VL-spacer-linker-P73-spacer (SEQ ID NO: 99)

MGWSCIILFLVATATGVHSDIQMTQSPSSLSASVGDRVTITCKASQDINKYIAWYQHKP
GKAPKLLIYYASNLQPGVPSRFSGSGSGRDFTFTISSLQPEDIATYYCLQYDNLLTFGA
GTKLELKR*GGGGSGGGGSGGGGSGGGGSGGGGSGGGGS*QVQLQQSGAEVVKPGASVK
VSCKASGYSFTDYNMYWVRQAPGQGLEWMGYIDPYKGGTIYNQKFQGRATLTRDTS
ISTAYMELSRLRSDDTAVYYCAREMITAYYFDYWGQGSSVTVSS*GGGGSGGGGSGGGG
SGGGGS*HVQLVESGGGLVQPGGSLRLSCAASGFSLTDYGVHWVRQAPGKGLEWLGVIWS
GGGTAYNTALISRFTISRDNSKNTLYLQMNSLRAEDTAVYYCARRGSYPYNYFDAWGCGT
LVTVSS*GGGGSGGGGSGGGGSGGGGSGGGGSGGGGS*QAVVTQEPSLTVSPGGTVTLTCGS
STGAVTASNYANWVQQKPGQCPRGLIGGHNNRPPGVPARFSGSLLGGKAALTLLGAQPED
EAEYYCALWYSDHWVIGGGTKLTVLG*TPLGDTTHT*SGR**HGDEDTYYLQVRGRENFEIL
MKLKESLELMELVPQPLVDSYRQQQQLLQRP**GGSGGA hHIM34 VH5-(G4S)₆-hHIM34 VL4-(G4S)₄-hC825 VH-(G4S)₆-hC825 VL-spacer-linker-P73-spacer-H6 (SEQ ID NO: 100)

MGWSCIILFLVATATGVHSQVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SGR**HGDEDTYYLQVRGRENFEILM
KLKESLELMELVPQPLVDSYRQQQQLLQRP**GGSGGAPHHHHHH hHIM34 VH5-(G4S)₆-hHIM34 VL4-(G4S)₄-hC825 VH-(G4S)₆-hC825 VL-spacer-linker-P73-spacer (SEQ ID NO: 101)

MGWSCIILFLVATATGVHSQVQLQQSGAEVVKPGASVKVSCKASGYSFTDYNMYWVR
QAPGQGLEWMGYIDPYKGGTIYNQKFQGRATLTRDTSISTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIYYASNLQPGVPSRFS
GSGSGRDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SGR**HGDEDTYYLQVRGRENFEILM
KLKESLELMELVPQPLVDSYRQQQQLLQRP**GGSGGA

Figure 15(Y)

hHIM34 VL3-(G4S)₆-hHIM34 VH4-(G4S)₄-hC825 VH-(G4S)₆-hC825 VL-spacer-linker-P53-spacer-H6 (SEQ ID NO: 102)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLVQSGAEVKKPGASVKV
SCKASGYSFTDYNMYWVRQAPGQGLEWIGYIDPYKGGTNYAQKFQGRATLTVDKSS
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGAPHHHHHH hHIM34 VL3-(G4S)₆-hHIM34 VH4-(G4S)₄-hC825 VH-(G4S)₆-hC825 VL-spacer-linker-P53-spacer (SEQ ID NO: 103)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLVQSGAEVKKPGASVKV
SCKASGYSFTDYNMYWVRQAPGQGLEWIGYIDPYKGGTNYAQKFQGRATLTVDKSS
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGA hHIM34 VH4-(G4S)₆-hHIM34 VL3-(G4S)₄-hC825 VH-(G4S)₆-hC825 VL-spacer-linker-P53-spacer-H6 (SEQ ID NO: 104)

<u>MGWSCIILFLVATATGVHS</u>QVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**KPLDGEYFTLQIRGRERFEMFRE
LNEALELKDAQAGKEP**GGSGGAPHHHHHH

Figure 15(Z)

hHIM34 VH4-(G4S)₆-hHIM34 VL3-(G4S)₄-hC825 VH-(G4S)₆-hC825 VL-spacer-linker-P53-spacer (SEQ ID NO: 105)

<u>MGWSCIILFLVATATGVHS</u>QVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SGKPLDGEYFTLQIRGRERFEMFRE
LNEALELKDAQAGKEPGGSGGA hHIM34 VL3-(G4S)₆-hHIM34 VH4-(G4S)₄-hC825 VH-(G4S)₆-hC825 VL-spacer-linker-P63-spacer-H6 (SEQ ID NO: 106)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLVQSGAEVKKPGASVKV
SCKASGYSFTDYNMYWVRQAPGQGLEWIGYIDPYKGGTNYAQKFQGRATLTVDKSS
STAYMELSRLRSDDTAVYYCAREMITAYYFDYWGQGSSVTVSS*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SGRSPDDELLYLPVRGRETYEMLLK
IKESLELMQYLPQHTIETYRQQQQQQHQHLLQKQGGSGGAPHHHHHH hHIM34 VL3-(G4S)₆-hHIM34 VH4-(G4S)₄-hC825 VH-(G4S)₆-hC825 VL-spacer-linker-P63-spacer (SEQ ID NO: 107)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLVQSGAEVKKPGASVKV
SCKASGYSFTDYNMYWVRQAPGQGLEWIGYIDPYKGGTNYAQKFQGRATLTVDKSS
STAYMELSRLRSDDTAVYYCAREMITAYYFDYWGQGSSVTVSS*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SGRSPDDELLYLPVRGRETYEMLLK
IKESLELMQYLPQHTIETYRQQQQQQHQHLLQKQGGSGGA

Figure 15(AA)

hHIM34 VH4-(G4S)₆-hHIM34 VL3-(G4S)₄-hC825 VH-(G4S)₆-hC825 VL-spacer-linker-P63-spacer-H6 (SEQ ID NO: 108)

MGWSCIILFLVATATGVHSQVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SGRSPDDELLYLPVRGRETYEMLLK
IKESLELMQYLPQHTIETYRQQQQQQHQHLLQKQGGSGGAPHHHHHH hHIM34 VH4-(G4S)₆-hHIM34 VL3-(G4S)₄-hC825 VH-(G4S)₆-hC825 VL-spacer-linker-P63-spacer (SEQ ID NO: 109)

MGWSCIILFLVATATGVHSQVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SGRSPDDELLYLPVRGRETYEMLLK
IKESLELMQYLPQHTIETYRQQQQQQHQHLLQKQGGSGGA hHIM34 VL3-(G4S)₆-hHIM34 VH4-(G4S)₄-hC825 VH-(G4S)₆-hC825 VL-spacer-linker-P73-spacer-H6 (SEQ ID NO: 110)

MGWSCIILFLVATATGVHSDIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLVQSGAEVKKPGASVKV
SCKASGYSFTDYNMYWVRQAPGQGLEWIGYIDPYKGGTNYAQKFQGRATLTVDKSS
STAYMELSRLRSDDTAVYYCAREMITAYYFDYWGQGSSVTVSS*GGGGSGGGGSGGGGS*
*GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SGRHGDEDTYYLQVRGRENFEILM
KLKESLELMELVPQPLVDSYRQQQQLLQRPGGSGGAPHHHHHH

Figure 15(BB)

hHIM34 VL3-(G4S)₆-hHIM34 VH4-(G4S)₄-hC825 VH-(G4S)₆-hC825 VL-spacer-linker-P73-spacer (SEQ ID NO: 111)

<u>MGWSCIILFLVATATGVHS</u>DIQMTQSPSSLSASVGDRVTITCKASQDINKYIAWYQHKP
GKAPKLLIHYTSTLETGVPSRFSGSGSGTDFTFTISSLQPEDIATYYCLQYDNLLTFGAG
TKLELKR*GGGGSGGGGSGGGGSGGGGSGGGGSGGGGS*QVQLVQSGAEVKKPGASVKV
SCKASGYSFTDYNMYWVRQAPGQGLEWIGYIDPYKGGTNYAQKFQGRATLTVDKSS
STAYMELSRLRSDDTAVYYCAREMITAYYFDYWGQGSSVTVSS*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGA hHIM34 VH4-(G4S)₆-hHIM34 VL3-(G4S)₄-hC825 VH-(G4S)₆-hC825 VL-spacer-linker-P73-spacer-H6 (SEQ ID NO: 112)

<u>MGWSCIILFLVATATGVHS</u>QVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGAPHHHHHH hHIM34 VH4-(G4S)₆-hHIM34 VL3-(G4S)₄-hC825 VH-(G4S)₆-hC825 VL-spacer-linker-P73-spacer (SEQ ID NO: 113)

<u>MGWSCIILFLVATATGVHS</u>QVQLVQSGAEVKKPGASVKVSCKASGYSFTDYNMYWVR
QAPGQGLEWIGYIDPYKGGTNYAQKFQGRATLTVDKSSSTAYMELSRLRSDDTAVYY
CAREMITAYYFDYWGQGSSVTVSS*GGGGSGGGGSGGGGSGGGGSGGGGSGGGGS*DIQM
TQSPSSLSASVGDRVTITCKASQDINKYIAWYQHKPGKAPKLLIHYTSTLETGVPSRFS
GSGSGTDFTFTISSLQPEDIATYYCLQYDNLLTFGAGTKLELKR*GGGGSGGGGSGGGGS
GGGGS*HVQLVESGGGLVQPGGSLRLSCAASGFSLTDYGVHWVRQAPGKGLEWLGVIWSG
GGTAYNTALISRFTISRDNSKNTLYLQMNSLRAEDTAVYYCARRGSYPYNYFDAWGCGTL
VTVSS*GGGGSGGGGSGGGGSGGGGSGGGGSGGGGS*QAVVTQEPSLTVSPGGTVTLTCGSS
TGAVTASNYANWVQQKPGQCPRGLIGGHNNRPPGVPARFSGSLLGGKAALTLLGAQPEDE
AEYYCALWYSDHWVIGGGTKLTVLG*TPLGDTTHT*SG**RHGDEDTYYLQVRGRENFEILM
KLKESLELMELVPQPLVDSYRQQQQLLQRP**GGSGGA

Figure 15(CC)

HIM34 mouseVL-(G4S)6-HIM34 mouseVH-(G4S)4-hC825 VH-(G4S)6- hC825 VL-spacer-linker-P53-spacer-H6 (SEQ ID NO: 142)

MGWSCIILFLVATATGVHSDIVMTQSPSSLSASLGGKVTITCKASQDINKYIAWYQHKP
GKGPRLLIHYTSTLQPGIPSRFSGSGSGRDYSFSISNLEPEDIATYYCLQYDNLLTFGAG
TKLELKR*GGGGSGGGGSGGGGSGGGGSGGGGSGGGGS*EVKLQQSGPELVKPGTSVKVS
CKASGYSFTDYNMYWVKQSHGKSLEWIGYIDPYKGGTIYNQKFKGKATLTVDKSSST
AFMHLNSLTSEDSAVYYCAREMITAYYFDYWGQGSSVTVSS*GGGGSGGGGSGGGGSGG
GGS*HVQLVESGGGLVQPGGSLRLSCAASGFSLTDYGVHWVRQAPGKGLEWLGVIWSGGG
TAYNTALISRFTISRDNSKNTLYLQMNSLRAEDTAVYYCARRGSYPYNYFDAWGCGTLVT
VSS*GGGGSGGGGSGGGGSGGGGSGGGGSGGGGS*QAVVTQEPSLTVSPGGTVTLTCGSSTG
AVTASNYANWVQQKPGQCPRGLIGGHNNRPPGVPARFSGSLLGGKAALTLLGAQPEDEAE
YYCALWYSDHWVIGGGTKLTVLG*TPLGDTTHT*SGKPLDGEYFTLQIRGRERFEMFRELNEA
LELKDAQAGKEPGGSGGAPHHHHHH

HIM34 mouseVL-(G4S)6-HIM34 mouseVH-(G4S)4-hC825 VH-(G4S)6- hC825 VL-spacer-Linker-P53 (SEQ ID NO: 143)

MGWSCIILFLVATATGVHSDIVMTQSPSSLSASLGGKVTITCKASQDINKYIAWYQHKP
GKGPRLLIHYTSTLQPGIPSRFSGSGSGRDYSFSISNLEPEDIATYYCLQYDNLLTFGAG
TKLELKR*GGGGSGGGGSGGGGSGGGGSGGGGSGGGGS*EVKLQQSGPELVKPGTSVKVS
CKASGYSFTDYNMYWVKQSHGKSLEWIGYIDPYKGGTIYNQKFKGKATLTVDKSSST
AFMHLNSLTSEDSAVYYCAREMITAYYFDYWGQGSSVTVSS*GGGGSGGGGSGGGGSGG
GGS*HVQLVESGGGLVQPGGSLRLSCAASGFSLTDYGVHWVRQAPGKGLEWLGVIWSGGG
TAYNTALISRFTISRDNSKNTLYLQMNSLRAEDTAVYYCARRGSYPYNYFDAWGCGTLVT
VSS*GGGGSGGGGSGGGGSGGGGSGGGGSGGGGS*QAVVTQEPSLTVSPGGTVTLTCGSSTG
AVTASNYANWVQQKPGQCPRGLIGGHNNRPPGVPARFSGSLLGGKAALTLLGAQPEDEAE
YYCALWYSDHWVIGGGTKLTVLG*TPLGDTTHT*SGKPLDGEYFTLQIRGRERFEMFRELNEA
LELKDAQAGKEPGGSGGA

HIM34 mouseVH-(G4S)6-HIM34 mouseVL-(G4S)4-hC825 VH-(G4S)6-hC825 VL-spacer-linker-P53-spacer-H6 (SEQ ID NO: 144)

MGWSCIILFLVATATGVHSEVKLQQSGPELVKPGTSVKVSCKASGYSFTDYNMYWVKQ
SHGKSLEWIGYIDPYKGGTIYNQKFKGKATLTVDKSSSTAFMHLNSLTSEDSAVYYCA
REMITAYYFDYWGQGSSVTVSS*GGGGSGGGGSGGGGSGGGGSGGGGSGGGGS*DIVMTQ
SPSSLSASLGGKVTITCKASQDINKYIAWYQHKPGKGPRLLIHYTSTLQPGIPSRFSGSG
SGRDYSFSISNLEPEDIATYYCLQYDNLLTFGAGTKLELKR*GGGGSGGGGSGGGGSGGG
GS*HVQLVESGGGLVQPGGSLRLSCAASGFSLTDYGVHWVRQAPGKGLEWLGVIWSGGGT
AYNTALISRFTISRDNSKNTLYLQMNSLRAEDTAVYYCARRGSYPYNYFDAWGCGTLVTV
SS*GGGGSGGGGSGGGGSGGGGSGGGGSGGGGS*QAVVTQEPSLTVSPGGTVTLTCGSSTGA
VTASNYANWVQQKPGQCPRGLIGGHNNRPPGVPARFSGSLLGGKAALTLLGAQPEDEAEY
YCALWYSDHWVIGGGTKLTVLG*TPLGDTTHT*SGKPLDGEYFTLQIRGRERFEMFRELNEAL
ELKDAQAGKEPGGSGGAPHHHHHH

Figure 15(DD)

HIM34 mouseVH-(G4S)6-HIM34 mouseVL-(G4S)4-hC825 VH-(G4S)6-hC825 VL-spacer-Linker-P53-spacer (SEQ ID NO: 145)

MGWSCIILFLVATATGVHSEVKLQQSGPELVKPGTSVKVSCKASGYSFTDYNMYWVKQ
SHGKSLEWIGYIDPYKGGTIYNQKFKGKATLTVDKSSSTAFMHLNSLTSEDSAVYYCA
REMITAYYFDYWGQGSSVTVSS*GGGGSGGGGSGGGGSGGGGSGGGGSGGGGS*DIVMTQ
SPSSLSASLGGKVTITCKASQDINKYIAWYQHKPGKGPRLLIHYTSTLQPGIPSRFSGSG
SGRDYSFSISNLEPEDIATYYCLQYDNLLTFGAGTKLELKR*GGGGSGGGGSGGGGSGGG
GS*HVQLVESGGGLVQPGGSLRLSCAASGFSLTDYGVHWVRQAPGKGLEWLGVIWSGGGT
AYNTALISRFTISRDNSKNTLYLQMNSLRAEDTAVYYCARRGSYPYNYFDAWGCGTLVTV
SS*GGGGSGGGGSGGGGSGGGGSGGGGSGGGGS*QAVVTQEPSLTVSPGGTVTLTCGSSTGA
VTASNYANWVQQKPGQCPRGLIGGHNNRPPGVPARFSGSLLGGKAALTLLGAQPEDEAEY
YCALWYSDHWVIGGGTKLTVLG*TPLGDTTHT*SGKPLDGEYFTLQIRGRERFEMFRELNEAL
ELKDAQAGKEPGGSGGA

HIM34 mouseVL-(G4S)6-HIM34 mouseVH-(G4S)4-hC825 VH-(G4S)6-hC825 VL-spacer-linker-P63-spacer-H6 (SEQ ID NO: 146)

MGWSCIILFLVATATGVHSDIVMTQSPSSLSASLGGKVTITCKASQDINKYIAWYQHKP
GKGPRLLIHYTSTLQPGIPSRFSGSGSGRDYSFSISNLEPEDIATYYCLQYDNLLTFGAG
TKLELKR*GGGGSGGGGSGGGGSGGGGSGGGGSGGGGS*EVKLQQSGPELVKPGTSVKVS
CKASGYSFTDYNMYWVKQSHGKSLEWIGYIDPYKGGTIYNQKFKGKATLTVDKSSST
AFMHLNSLTSEDSAVYYCAREMITAYYFDYWGQGSSVTVSS*GGGGSGGGGSGGGGSGG
GGS*HVQLVESGGGLVQPGGSLRLSCAASGFSLTDYGVHWVRQAPGKGLEWLGVIWSGGG
TAYNTALISRFTISRDNSKNTLYLQMNSLRAEDTAVYYCARRGSYPYNYFDAWGCGTLVT
VSS*GGGGSGGGGSGGGGSGGGGSGGGGSGGGGS*QAVVTQEPSLTVSPGGTVTLTCGSSTG
AVTASNYANWVQQKPGQCPRGLIGGHNNRPPGVPARFSGSLLGGKAALTLLGAQPEDEAE
YYCALWYSDHWVIGGGTKLTVLG*TPLGDTTHT*SGRSPDDELLYLPVRGRETYEMLLKIKES
LELMQYLPQHTIETYRQQQQQQHQHLLQKQGGSGGAPHHHHHH

HIM34 mouseVL-(G4S)6-HIM34 mouseVH-(G4S)4-hC825 VH-(G4S)6-hC825 VL-spacer-linker-P63-spacer (SEQ ID NO: 147)

MGWSCIILFLVATATGVHSDIVMTQSPSSLSASLGGKVTITCKASQDINKYIAWYQHKP
GKGPRLLIHYTSTLQPGIPSRFSGSGSGRDYSFSISNLEPEDIATYYCLQYDNLLTFGAG
TKLELKR*GGGGSGGGGSGGGGSGGGGSGGGGSGGGGS*EVKLQQSGPELVKPGTSVKVS
CKASGYSFTDYNMYWVKQSHGKSLEWIGYIDPYKGGTIYNQKFKGKATLTVDKSSST
AFMHLNSLTSEDSAVYYCAREMITAYYFDYWGQGSSVTVSS*GGGGSGGGGSGGGGSGG
GGS*HVQLVESGGGLVQPGGSLRLSCAASGFSLTDYGVHWVRQAPGKGLEWLGVIWSGGG
TAYNTALISRFTISRDNSKNTLYLQMNSLRAEDTAVYYCARRGSYPYNYFDAWGCGTLVT
VSS*GGGGSGGGGSGGGGSGGGGSGGGGSGGGGS*QAVVTQEPSLTVSPGGTVTLTCGSSTG
AVTASNYANWVQQKPGQCPRGLIGGHNNRPPGVPARFSGSLLGGKAALTLLGAQPEDEAE
YYCALWYSDHWVIGGGTKLTVLG*TPLGDTTHT*SGRSPDDELLYLPVRGRETYEMLLKIKES
LELMQYLPQHTIETYRQQQQQQHQHLLQKQGGSGGA

Figure 15(EE)

HIM34 mouseVH-(G4S)6-HIM34 mouseVL-(G4S)4-hC825 VH-(G4S)6-hC825 VL-spacer-linker-P63-spacer-H6 (SEQ ID NO: 148)

MGWSCIILFLVATATGVHSEVKLQQSGPELVKPGTSVKVSCKASGYSFTDYNMYWVKQ
SHGKSLEWIGYIDPYKGGTIYNQKFKGKATLTVDKSSSTAFMHLNSLTSEDSAVYYCA
REMITAYYFDYWGQGSSVTVSS*GGGGSGGGGSGGGGSGGGGSGGGGSGGGGS*DIVMTQ
SPSSLSASLGGKVTITCKASQDINKYIAWYQHKPGKGPRLLIHYTSTLQPGIPSRFSGSG
SGRDYSFSISNLEPEDIATYYCLQYDNLLTFGAGTKLELKR*GGGGSGGGGSGGGGSGGG
GS*HVQLVESGGGLVQPGGSLRLSCAASGFSLTDYGVHWVRQAPGKGLEWLGVIWSGGGT
AYNTALISRFTISRDNSKNTLYLQMNSLRAEDTAVYYCARRGSYPYNYFDAWGCGTLVTV
SS*GGGGSGGGGSGGGGSGGGGSGGGGSGGGGS*QAVVTQEPSLTVSPGGTVTLTCGSSTGA
VTASNYANWVQQKPGQCPRGLIGGHNNRPPGVPARFSGSLLGGKAALTLLGAQPEDEAEY
YCALWYSDHWVIGGGTKLTVLG*TPLGDTTHT*SGRSPDDELLYLPVRGRETYEMLLKIKESL
ELMQYLPQHTIETYRQQQQQQHQHLLQKQGGSGGAPHHHHHH

HIM34 mouseVH-(G4S)6-HIM34 mouseVL-(G4S)4-hC825 VH-(G4S)6-hC825 VL-spacer-linker-P63-spacer (SEQ ID NO: 149)

MGWSCIILFLVATATGVHSEVKLQQSGPELVKPGTSVKVSCKASGYSFTDYNMYWVKQ
SHGKSLEWIGYIDPYKGGTIYNQKFKGKATLTVDKSSSTAFMHLNSLTSEDSAVYYCA
REMITAYYFDYWGQGSSVTVSS*GGGGSGGGGSGGGGSGGGGSGGGGSGGGGS*DIVMTQ
SPSSLSASLGGKVTITCKASQDINKYIAWYQHKPGKGPRLLIHYTSTLQPGIPSRFSGSG
SGRDYSFSISNLEPEDIATYYCLQYDNLLTFGAGTKLELKR*GGGGSGGGGSGGGGSGGG
GS*HVQLVESGGGLVQPGGSLRLSCAASGFSLTDYGVHWVRQAPGKGLEWLGVIWSGGGT
AYNTALISRFTISRDNSKNTLYLQMNSLRAEDTAVYYCARRGSYPYNYFDAWGCGTLVTV
SS*GGGGSGGGGSGGGGSGGGGSGGGGSGGGGS*QAVVTQEPSLTVSPGGTVTLTCGSSTGA
VTASNYANWVQQKPGQCPRGLIGGHNNRPPGVPARFSGSLLGGKAALTLLGAQPEDEAEY
YCALWYSDHWVIGGGTKLTVLG*TPLGDTTHT*SGRSPDDELLYLPVRGRETYEMLLKIKESL
ELMQYLPQHTIETYRQQQQQQHQHLLQKQGGSGGA

HIM34 mouseVL-(G4S)6-HIM34 mouseVH-(G4S)4-hC825 VH-(G4S)6-hC825 VL-spacer-linker-P73-spacer-H6 (SEQ ID NO: 150)

MGWSCIILFLVATATGVHSDIVMTQSPSSLSASLGGKVTITCKASQDINKYIAWYQHKP
GKGPRLLIHYTSTLQPGIPSRFSGSGSGRDYSFSISNLEPEDIATYYCLQYDNLLTFGAG
TKLELKR*GGGGSGGGGSGGGGSGGGGSGGGGSGGGGS*EVKLQQSGPELVKPGTSVKVS
CKASGYSFTDYNMYWVKQSHGKSLEWIGYIDPYKGGTIYNQKFKGKATLTVDKSSST
AFMHLNSLTSEDSAVYYCAREMITAYYFDYWGQGSSVTVSS*GGGGSGGGGSGGGGSGG
GS*HVQLVESGGGLVQPGGSLRLSCAASGFSLTDYGVHWVRQAPGKGLEWLGVIWSGGG
TAYNTALISRFTISRDNSKNTLYLQMNSLRAEDTAVYYCARRGSYPYNYFDAWGCGTLVT
VSS*GGGGSGGGGSGGGGSGGGGSGGGGSGGGGS*QAVVTQEPSLTVSPGGTVTLTCGSSTG
AVTASNYANWVQQKPGQCPRGLIGGHNNRPPGVPARFSGSLLGGKAALTLLGAQPEDEAE
YYCALWYSDHWVIGGGTKLTVLG*TPLGDTTHT*SGRHGDEDTYYLQVRGRENFEILMKLKE
SLELMELVPQPLVDSYRQQQQLLQRPGGSGGAPHHHHHH

Figure 15(FF)

HIM34 mouseVL-(G4S)6-HIM34 mouseVH-(G4S)4-hC825 VH-(G4S)6-hC825 VL-spacer-linker-P73-spacer (SEQ ID NO: 151)

MGWSCIILFLVATATGVHSDIVMTQSPSSLSASLGGKVTITCKASQDINKYIAWYQHKP
GKGPRLLIHYTSTLQPGIPSRFSGSGSGRDYSFSISNLEPEDIATYYCLQYDNLLTFGAG
TKLELKR*GGGGSGGGGSGGGGSGGGGSGGGGSGGGGS*EVKLQQSGPELVKPGTSVKVS
CKASGYSFTDYNMYWVKQSHGKSLEWIGYIDPYKGGTIYNQKFKGKATLTVDKSSST
AFMHLNSLTSEDSAVYYCAREMITAYYFDYWGQGSSVTVSS*GGGGSGGGGSGGGGSGG
GGS*HVQLVESGGGLVQPGGSLRLSCAASGFSLTDYGVHWVRQAPGKGLEWLGVIWSGGG
TAYNTALISRFTISRDNSKNTLYLQMNSLRAEDTAVYYCARRGSYPYNYFDAWGCGTLVT
VSS*GGGGSGGGGSGGGGSGGGGSGGGGSGGGGS*QAVVTQEPSLTVSPGGTVTLTCGSSTG
AVTASNYANWVQQKPGQCPRGLIGGHNNRPPGVPARFSGSLLGGKAALTLLGAQPEDEAE
YYCALWYSDHWVIGGGTKLTVLG*TPLGDTTHT*SGRHGDEDTYYLQVRGRENFEILMKLKE
SLELMELVPQPLVDSYRQQQQLLQRPGGSGGA

HIM34 mouseVH-(G4S)6-HIM34 mouseVL-(G4S)4-hC825 VH-(G4S)6-hC825 VL-spacer-linker-P73-spacer-H6 (SEQ ID NO: 152)

MGWSCIILFLVATATGVHSEVKLQQSGPELVKPGTSVKVSCKASGYSFTDYNMYWVKQ
SHGKSLEWIGYIDPYKGGTIYNQKFKGKATLTVDKSSSTAFMHLNSLTSEDSAVYYCA
REMITAYYFDYWGQGSSVTVSS*GGGGSGGGGSGGGGSGGGGSGGGGSGGGGS*DIVMTQ
SPSSLSASLGGKVTITCKASQDINKYIAWYQHKPGKGPRLLIHYTSTLQPGIPSRFSGSG
SGRDYSFSISNLEPEDIATYYCLQYDNLLTFGAGTKLELKR*GGGGSGGGGSGGGGSGGG
GS*HVQLVESGGGLVQPGGSLRLSCAASGFSLTDYGVHWVRQAPGKGLEWLGVIWSGGGT
AYNTALISRFTISRDNSKNTLYLQMNSLRAEDTAVYYCARRGSYPYNYFDAWGCGTLVTV
SS*GGGGSGGGGSGGGGSGGGGSGGGGSGGGGS*QAVVTQEPSLTVSPGGTVTLTCGSSTGA
VTASNYANWVQQKPGQCPRGLIGGHNNRPPGVPARFSGSLLGGKAALTLLGAQPEDEAEY
YCALWYSDHWVIGGGTKLTVLG*TPLGDTTHT*SGRHGDEDTYYLQVRGRENFEILMKLKES
LELMELVPQPLVDSYRQQQQLLQRPGGSGGAPHHHHHH

HIM34 mouseVH-(G4S)6-HIM34 mouseVL-(G4S)4-hC825 VH-(G4S)6-hC825 VL-spacer-linker-P73-spacer (SEQ ID NO: 153)

MGWSCIILFLVATATGVHSEVKLQQSGPELVKPGTSVKVSCKASGYSFTDYNMYWVKQ
SHGKSLEWIGYIDPYKGGTIYNQKFKGKATLTVDKSSSTAFMHLNSLTSEDSAVYYCA
REMITAYYFDYWGQGSSVTVSS*GGGGSGGGGSGGGGSGGGGSGGGGSGGGGS*DIVMTQ
SPSSLSASLGGKVTITCKASQDINKYIAWYQHKPGKGPRLLIHYTSTLQPGIPSRFSGSG
SGRDYSFSISNLEPEDIATYYCLQYDNLLTFGAGTKLELKR*GGGGSGGGGSGGGGSGGG
GS*HVQLVESGGGLVQPGGSLRLSCAASGFSLTDYGVHWVRQAPGKGLEWLGVIWSGGGT
AYNTALISRFTISRDNSKNTLYLQMNSLRAEDTAVYYCARRGSYPYNYFDAWGCGTLVTV
SS*GGGGSGGGGSGGGGSGGGGSGGGGSGGGGS*QAVVTQEPSLTVSPGGTVTLTCGSSTGA
VTASNYANWVQQKPGQCPRGLIGGHNNRPPGVPARFSGSLLGGKAALTLLGAQPEDEAEY
YCALWYSDHWVIGGGTKLTVLG*TPLGDTTHT*SGRHGDEDTYYLQVRGRENFEILMKLKES
LELMELVPQPLVDSYRQQQQLLQRPGGSGGA

Figure 16(A)

| VL+VH | IgG yield Conc. (mg/ml) | IgG yield Yield (mg) | IgG purity CE-SDS | IgG stability HPLC 10X Freeze/thaw | IgG 40°C stability d0 | IgG 40°C stability d5 | IgG 40°C stability d12 | IgG 40°C stability d21 | IgG Kinetics (Biacore) Kon | IgG Kinetics (Biacore) Koff | IgG Kinetics (Biacore) KD |
|---|---|---|---|---|---|---|---|---|---|---|---|
| L2 (SEQ ID NO: 10) +H6 (SEQ ID NO: 7) | 0.67 | 0.80 | | 60.83 | 62.3 | 60.7 | 61.3 | | | | |
| L2 (SEQ ID NO: 10) +H5 (SEQ ID NO: 6) | 0.95 | 0.95 | | 58.54 | 60.0 | 58.3 | 57.8 | | | | |
| L1 (SEQ ID NO: 9) +H6 (SEQ ID NO: 7) | 0.97 | 0.97 | | 70.25 | 72.2 | 70.3 | 70.1 | 68.0 | | | |
| L1 (SEQ ID NO: 9) +H5 (SEQ ID NO: 6) | 0.92 | 1.10 | | 69.97 | 71.8 | 70.3 | 68.8 | | | | |
| L3 (SEQ ID NO: 11) +H6 (SEQ ID NO: 7) | 1.25 | 1.13 | 99.5 | 95.51 | 97.9 | 96.3 | 95.1 | 92.7 | 2.1E+06 | 1.3E-04 | 5.9E-11 |
| L5 (SEQ ID NO: 13) +H6 (SEQ ID NO: 7) | 2.82 | 1.76 | 99.7 | 92.54 | 95.6 | 93.9 | 93.0 | 90.5 | 3.9E+06 | 3.9E-04 | 9.9E-11 |
| L3 (SEQ ID NO: 11) +H4 (SEQ ID NO: 5) | 1.77 | 10.24 | | 78.63 | 80.2 | 73.6 | 68.1 | | | | 5.5E-10 |
| L3 (SEQ ID NO: 11) +H1 (SEQ ID NO: 2) | 1.78 | 10.86 | | 62.17 | 64.6 | 63.7 | 56.1 | | | | 4.3E-10 |
| L4 (SEQ ID NO: 12) +H3 (SEQ ID NO: 4) | 2.36 | 13.21 | | 92.53 | 95.1 | 89.3 | 81.2 | 72.7 | | | 7.9E-09 |
| L5 (SEQ ID NO: 13) +H3 (SEQ ID NO: 4) | 2.63 | 14.19 | | 89.43 | 92.0 | 85.6 | 78.6 | 72.8 | | | 4.0E-09 |
| L4 (SEQ ID NO: 12) +H1 (SEQ ID NO: 2) | 2.70 | 14.85 | | 80.57 | 82.3 | 77.1 | 71.2 | 64.6 | | | 6.2E-10 |
| L5 (SEQ ID NO: 13) +H1 (SEQ ID NO: 2) | 2.68 | 15.02 | | 74.33 | 76.4 | 71.6 | 66.0 | | | | 1.3E-09 |
| L4 (SEQ ID NO: 12) +H4 (SEQ ID NO: 5) | 3.07 | 17.81 | | 88.08 | 90.8 | 86.7 | 81.4 | 71.6 | | | 9.0E-10 |
| chimeric | 3.21 | 18.27 | 53.7 | 95.39 | 97.9 | 88.4 | 77.3 | 68.1 | 3.4E+06 | 2.2E-04 | 6.4E-11 |
| L5 (SEQ ID NO: 13) +H4 (SEQ ID NO: 5) | 3.47 | 18.41 | | 84.46 | 86.8 | 80.1 | 73.7 | 67.7 | | | 1.8E-09 |
| L3 (SEQ ID NO: 11) +H5 (SEQ ID NO: 6) | 1.90 | 2.09 | 96.6 | 95.26 | 97.9 | 96.3 | 95.5 | 93.5 | 1.6E+06 | 1.2E-04 | 7.8E-11 |
| L1 (SEQ ID NO: 9) +H3 (SEQ ID NO: 4) | 0.97 | 2.14 | | 54.27 | 54.6 | 47.6 | 38.8 | | | | |
| L3 (SEQ ID NO: 11) +H2 (SEQ ID NO: 3) | 1.11 | 2.87 | | 80.74 | 83.5 | 75.2 | 63.3 | | | | |

Figure 16(B)

| VL+VH | IgG yield Conc. (mg/ml) | IgG yield Yield (mg) | IgG purity CE-SDS | IgG stability HPLC 10X Freeze/thaw | IgG 40°C stability d0 | IgG 40°C stability d5 | IgG 40°C stability d12 | IgG 40°C stability d21 | IgG Kinetics (Biacore) Kon | IgG Kinetics (Biacore) Koff | IgG Kinetics (Biacore) KD |
|---|---|---|---|---|---|---|---|---|---|---|---|
| L2 (SEQ ID NO: 10) +H3 (SEQ ID NO: 4) | 1.06 | 2.97 | | 54.27 | 55.3 | 48.8 | 41.1 | | | | |
| L2 (SEQ ID NO: 10) +H2 (SEQ ID NO: 3) | 1.04 | 3.21 | | 41.35 | 41.9 | 38.2 | 32.6 | | | | |
| L4 (SEQ ID NO: 12) +H6 (SEQ ID NO: 7) | 1.86 | 3.73 | 99.9 | 95.00 | 97.8 | 95.3 | 93.8 | 91.8 | 4.3E+06 | 2.1E-04 | 4.9E-11 |
| L5 (SEQ ID NO: 13) +H5 (SEQ ID NO: 6) | 1.92 | 4.22 | 95.9 | 94.16 | 96.8 | 95.0 | 94.5 | 91.0 | 4.4E+06 | 4.4E-04 | 1.0E-10 |
| L1 (SEQ ID NO: 9) +H2 (SEQ ID NO: 3) | 0.84 | 5.44 | | 54.48 | 55.2 | 50.1 | 45.6 | | | | |
| L2 (SEQ ID NO: 10) +H1 (SEQ ID NO: 2) | 0.89 | 5.52 | | 67.56 | 68.4 | 61.9 | 55.7 | | | | |
| L1 (SEQ ID NO: 9) +H4 (SEQ ID NO: 5) | 1.12 | 6.86 | | 81.02 | 83.9 | 75.6 | 67.8 | | | | |
| L1 (SEQ ID NO: 9) +H1 (SEQ ID NO: 2) | 1.30 | 6.87 | | 64.13 | 65.0 | 57.7 | 50.4 | | | | |
| L3 (SEQ ID NO: 11) +H3 (SEQ ID NO: 4) | 1.19 | 7.16 | | 91.88 | 91.8 | 88.4 | 81.9 | 70.8 | | | 7.2E-09 |
| L4 (SEQ ID NO: 12) +H5 (SEQ ID NO: 6) | 1.33 | 7.69 | | 94.70 | 97.4 | 88.2 | 79.4 | 71.3 | 5.9E+06 | 2.5E-04 | 4.3E-11 |
| L2 (SEQ ID NO: 10) +H4 (SEQ ID NO: 5) | 1.31 | 7.85 | | 78.70 | 80.1 | 74.4 | 67.5 | | | | |
| L5 (SEQ ID NO: 13) +H2 (SEQ ID NO: 3) | 1.52 | 7.88 | | 76.97 | 79.4 | 74.7 | 68.5 | | | | 2.2E-09 |
| L4 (SEQ ID NO: 12) +H2 (SEQ ID NO: 3) | 1.69 | 9.81 | | 87.35 | 89.5 | 82.5 | 75.6 | 67.4 | | | 5.2E-09 |

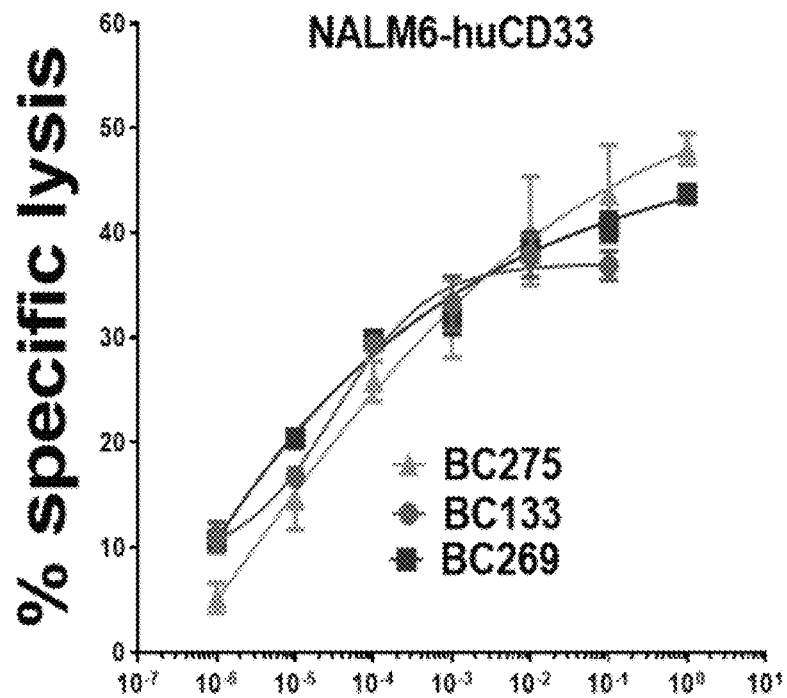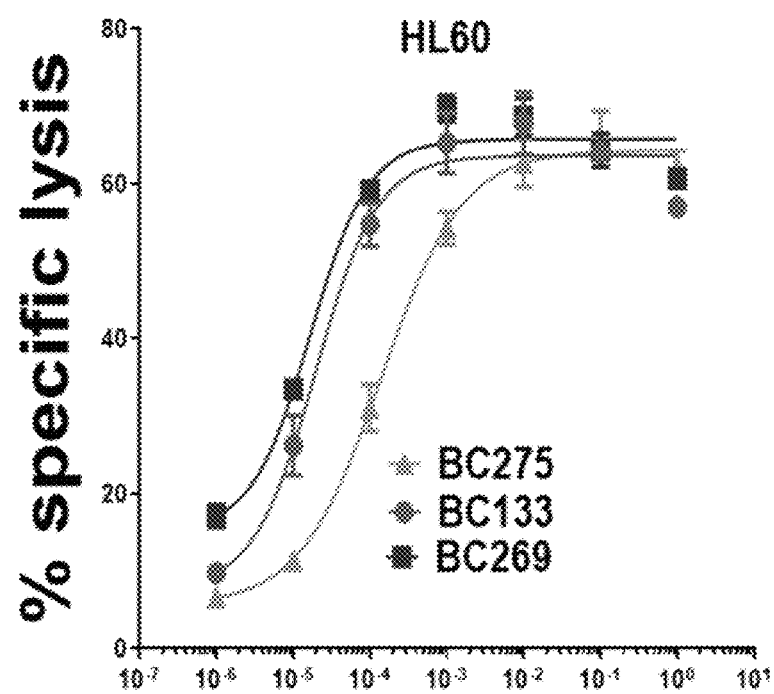
Figure 21(A)

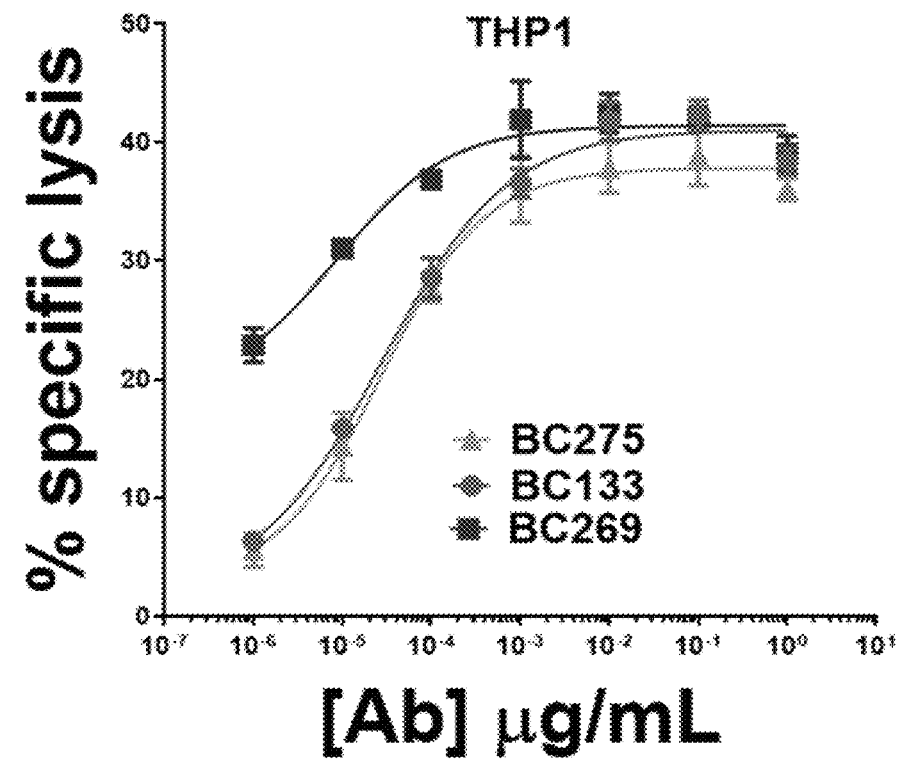
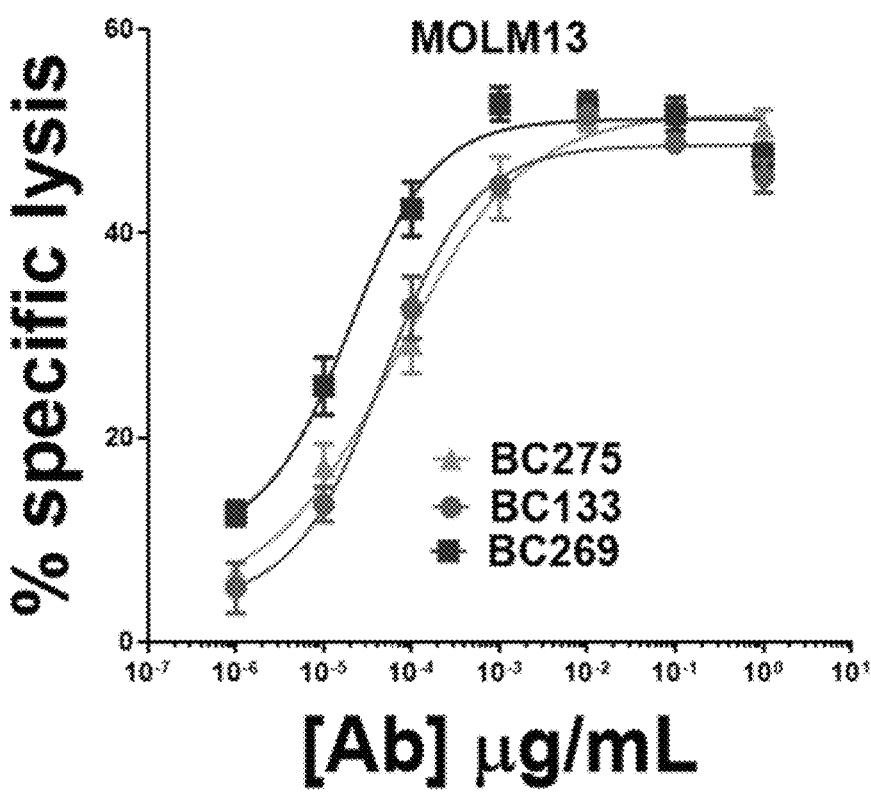
Figure 21(B)

CD33 ANTIBODIES AND METHODS OF USING THE SAME TO TREAT CANCER

CROSS-REFERENCE TO RELATED APPLICATIONS

This application is a U.S. National Stage Application under 35 U.S.C. § 371 of International Patent Application No. PCT/US2020/019351, filed on Feb. 21, 2020, which claims the benefit of and priority to U.S. Provisional Patent Application No. 62/809,091, filed Feb. 22, 2019, the entire contents of which are incorporated herein by reference.

SEQUENCE LISTING

The instant application contains a Sequence Listing which has been submitted electronically in ASCII format and is hereby incorporated by reference in its entirety. Said ASCII copy, created on Mar. 31, 2020, is named 115872-0653_SL.txt and is 664,587 bytes in size.

TECHNICAL FIELD

The present technology relates generally to the preparation of immunoglobulin-related compositions (e.g., antibodies or antigen binding fragments thereof) that specifically bind CD33 protein and uses of the same. In particular, the present technology relates to the preparation of CD33 binding antibodies and their use in detecting and treating CD33-associated cancers and Alzheimer's disease.

BACKGROUND

The following description of the background of the present technology is provided simply as an aid in understanding the present technology and is not admitted to describe or constitute prior art to the present technology.

Acute Myeloid leukemia (AML) accounts for 25% of pediatric leukemia but more than half of childhood leukemia deaths. In contrast to acute lymphoid leukemia that is curable in >80% of children, pediatric AML has the worst 5-year survival among childhood cancers. Among adults, in those patients diagnosed before 60 years of age, AML is curable in 35-40% of cases, whereas only 5-15% of those presenting later in life can be cured (Dohner et al., *N Engl J Med* 373:1136-52 (2015)).

SUMMARY OF THE PRESENT TECHNOLOGY

In one aspect, the present disclosure provides an antibody or antigen binding fragment thereof comprising a heavy chain immunoglobulin variable domain ($V_H$) and a light chain immunoglobulin variable domain ($V_L$), wherein (a) the $V_H$ comprises a $V_H$-CDR1 sequence of GYSFTDYN (SEQ ID NO: 154), a $V_H$-CDR2 sequence of IDPYKGGT (SEQ ID NO: 155), and a $V_H$-CDR3 sequence of AREMITAYYFDY (SEQ ID NO: 156), and (b) the $V_L$ comprises a $V_L$-CDR1 sequence of QDINKY (SEQ ID NO: 157), a $V_L$-CDR2 sequence of YAS (SEQ ID NO: 158), and a $V_L$-CDR3 sequence of LQYDNLLT (SEQ ID NO: 159).

In one aspect, the present disclosure provides an antibody or antigen binding fragment thereof comprising a heavy chain immunoglobulin variable domain ($V_H$) and and a light chain immunoglobulin variable domain ($V_L$), wherein: (a) the $V_H$ comprises an amino acid sequence selected from the group consisting of: SEQ ID NO: 2, SEQ ID NO: 3, SEQ ID NO: 4, SEQ ID NO: 5, SEQ ID NO: 6, SEQ ID NO: 7, and SEQ ID NO: 133; and/or (b) the $V_L$ comprises an amino acid sequence selected from the group consisting of: SEQ ID NO: 9, SEQ ID NO: 10, SEQ ID NO: 11, SEQ ID NO: 12, and SEQ ID NO: 13.

In any of the above embodiments, the antibody may further comprise an Fc domain of an isotype selected from the group consisting of IgG1, IgG2, IgG3, IgG4, IgA1, IgA2, IgM, IgD, and IgE. In some embodiments, the antibody comprises an IgG1 constant region comprising one or more amino acid substitutions selected from the group consisting of N297A and K322A. Additionally or alternatively, in some embodiments, the antibody comprises an IgG4 constant region comprising a S228P mutation. In certain embodiments, the antigen binding fragment is selected from the group consisting of Fab, F(ab')2, Fab', scFv, and $F_v$. In some embodiments, the antibody is a monoclonal antibody, chimeric antibody, humanized antibody, or a bispecific antibody. In certain embodiments, the antibody or antigen binding fragment binds to the IgC2 domain of CD33.

In another aspect, the present disclosure provides an antibody comprising a heavy chain (HC) amino acid sequence comprising SEQ ID NO: 16, SEQ ID NO: 20, SEQ ID NO: 22, SEQ ID NO: 136, SEQ ID NO: 139, SEQ ID NO: 141, or a variant thereof having one or more conservative amino acid substitutions, and/or a light chain (LC) amino acid sequence comprising SEQ ID NO: 14, SEQ ID NO: 18, SEQ ID NO: 24, SEQ ID NO: 26, SEQ ID NO: 27, SEQ ID NO: 28, SEQ ID NO: 29, SEQ ID NO: 134, SEQ ID NO: 138, SEQ ID NO: 140, or a variant thereof having one or more conservative amino acid substitutions. In certain embodiments, the antibody comprises a HC amino acid sequence and a LC amino acid sequence selected from the group consisting of: SEQ ID NO: 16 and SEQ ID NO: 14 (chHIM34×CD3 BsAb); SEQ ID NO: 20 and SEQ ID NO: 18 (BC249—hHIM34×CD3 BsAb); SEQ ID NO: 136 and SEQ ID NO: 134 (BC275—hHIM34×CD3 BsAb); SEQ ID NO: 22 and SEQ ID NO: 18 (BC267—hHIM34×CD3 BsAb); SEQ ID NO: 22 and SEQ ID NO: 24 (BC268—hHIM34×CD3 BsAb); SEQ ID NO: 20 and SEQ ID NO: 26 (VL3VH5×mC825); SEQ ID NO: 20 and SEQ ID NO: 27 (VL3VH5×hC825); SEQ ID NO: 22 and SEQ ID NO: 26 (VL3VH6×mC825); SEQ ID NO: 22 and SEQ ID NO: 27 (VL3VH6×hC825); SEQ ID NO: 22 and SEQ ID NO: 28 (VL4VH6×mC825); SEQ ID NO: 22 and SEQ ID NO: 29 (VL4VH6×hC825), SEQ ID NO: 139 and SEQ ID NO: 138 (mouse VL-mouseVH×mC825); and SEQ ID NO: 141 and SEQ ID NO: 140 (mouse VL-mouseVH×hC825), respectively.

In one aspect, the present disclosure provides an antibody comprising (a) a light chain immunoglobulin variable domain sequence that is at least 80%, at least 85%, at least 90%, at least 95%, or at least 99% identical to the light chain immunoglobulin variable domain sequence present in any one of SEQ ID NOs: 9, 10, 11, 12, or 13; and/or (b) a heavy chain immunoglobulin variable domain sequence that is at least 80%, at least 85%, at least 90%, at least 95%, or at least 99% identical to the heavy chain immunoglobulin variable domain sequence present in any one of SEQ ID NOs: 2, 3, 4, 5, 6, 7, or 133.

In another aspect, the present disclosure provides an antibody comprising (a) a LC sequence that is at least 80%, at least 85%, at least 90%, at least 95%, or at least 99% identical to the LC sequence present in any one of SEQ ID NOs: 14, 18, 24, 26, 27, 28, 29, 134, 138, or 140; and/or (b) a HC sequence that is at least 80%, at least 85%, at least 90%, at least 95%, or at least 99% identical to the HC sequence present in any one of SEQ ID NOs: 16, 20, 22, 136, 139, or 141.

In any of the above embodiments, the antibody is a chimeric antibody, a humanized antibody, or a bispecific antibody. Additionally or alternatively, in some embodiments, the antibody comprises an IgG1 constant region comprising one or more amino acid substitutions selected from the group consisting of N297A and K322A. In certain embodiments, the antibody of the present technology comprises an IgG4 constant region comprising a S228P mutation. In any of the above embodiments, the antibody binds to the IgC2 domain of CD33. Additionally or alternatively, in some embodiments, the antibody of the present technology lacks α-1,6-fucose modifications.

In one aspect, the present disclosure provides a bispecific antibody or antigen binding fragment comprising an amino acid sequence that is at least 95% identical to an amino acid sequence selected from any one of SEQ ID NOs. 30-113 or 142-153. In certain embodiments, the bispecific antibody or antigen binding fragment comprises an amino acid sequence selected from any one of SEQ ID NOs. 30-113 or 142-153.

In one aspect, the present disclosure provides a bispecific antigen binding fragment comprising a first polypeptide chain, wherein the first polypeptide chain comprises in the N-terminal to C-terminal direction: (i) a heavy chain variable domain of a first immunoglobulin that is capable of specifically binding to a first epitope; (ii) a flexible peptide linker comprising the amino acid sequence (GGGGS)$_6$ (SEQ ID NO: 161); (iii) a light chain variable domain of the first immunoglobulin; (iv) a flexible peptide linker comprising the amino acid sequence (GGGGS)$_4$ (SEQ ID NO: 162); (v) a heavy chain variable domain of a second immunoglobulin that is capable of specifically binding to a second epitope; (vi) a flexible peptide linker comprising the amino acid sequence (GGGGS)$_6$ (SEQ ID NO: 161); (vii) a light chain variable domain of the second immunoglobulin; (viii) a flexible peptide linker sequence comprising the amino acid sequence TPLGDTTHT (SEQ ID NO: 163); and (ix) a self-assembly disassembly (SADA) polypeptide, wherein the heavy chain variable domain of the first immunoglobulin is selected from the group consisting of: SEQ ID NO: 2, SEQ ID NO: 3, SEQ ID NO: 4, SEQ ID NO: 5, SEQ ID NO: 6, SEQ ID NO: 7, and SEQ ID NO: 133; and/or the light chain variable domain of the first immunoglobulin is selected from the group consisting of: SEQ ID NO: 9, SEQ ID NO: 10, SEQ ID NO: 11, SEQ ID NO: 12, and SEQ ID NO: 13.

In another aspect, the present disclosure provides a bispecific antigen binding fragment comprising a first polypeptide chain, wherein: the first polypeptide chain comprises in the N-terminal to C-terminal direction: (i) a light chain variable domain of a first immunoglobulin that is capable of specifically binding to a first epitope; (ii) a flexible peptide linker comprising the amino acid sequence (GGGGS)$_6$ (SEQ ID NO: 161); (iii) a heavy chain variable domain of the first immunoglobulin; (iv) a flexible peptide linker comprising the amino acid sequence (GGGGS)$_4$ (SEQ ID NO: 162); (v) a heavy chain variable domain of a second immunoglobulin that is capable of specifically binding to a second epitope; (vi) a flexible peptide linker comprising the amino acid sequence (GGGGS)$_6$ (SEQ ID NO: 161); (vii) a light chain variable domain of the second immunoglobulin; (viii) a flexible peptide linker sequence comprising the amino acid sequence TPLGDTTHT (SEQ ID NO: 163); and (ix) a self-assembly disassembly (SADA) polypeptide, wherein the heavy chain variable domain of the first immunoglobulin is selected from the group consisting of: SEQ ID NO: 2, SEQ ID NO: 3, SEQ ID NO: 4, SEQ ID NO: 5, SEQ ID NO: 6, SEQ ID NO: 7, and SEQ ID NO: 133; and/or the light chain variable domain of the first immunoglobulin is selected from the group consisting of: SEQ ID NO: 9, SEQ ID NO: 10, SEQ ID NO: 11, SEQ ID NO: 12, and SEQ ID NO: 13. In certain embodiments of the bispecific antigen binding fragments disclosed herein, the SADA polypeptide comprises a tetramerization, pentamerization, or hexamerization domain. In some embodiments, the SADA polypeptide comprises a tetramerization domain of any one of p53, p63, p'73, hnRNPC, SNA-23, Stefin B, KCNQ4, and CBFA2T1. Additionally or alternatively, in some embodiments, the bispecific antigen binding fragment comprises an amino acid sequence selected from SEQ ID NOs. 30-113 or 142-153.

In one aspect, the present disclosure provides a bispecific antibody comprising a first polypeptide chain, a second polypeptide chain, a third polypeptide chain and a fourth polypeptide chain, wherein the first and second polypeptide chains are covalently bonded to one another, the second and third polypeptide chains are covalently bonded to one another, and the third and fourth polypeptide chain are covalently bonded to one another, and wherein: (a) each of the first polypeptide chain and the fourth polypeptide chain comprises in the N-terminal to C-terminal direction: (i) a light chain variable domain of a first immunoglobulin that is capable of specifically binding to a first epitope; (ii) a light chain constant domain of the first immunoglobulin; (iii) a flexible peptide linker comprising the amino acid sequence (GGGGS)$_3$ (SEQ ID NO: 164); and (iv) a light chain variable domain of a second immunoglobulin that is linked to a complementary heavy chain variable domain of the second immunoglobulin, or a heavy chain variable domain of a second immunoglobulin that is linked to a complementary light chain variable domain of the second immunoglobulin, wherein the light chain and heavy chain variable domains of the second immunoglobulin are capable of specifically binding to a second epitope, and are linked together via a flexible peptide linker comprising the amino acid sequence (GGGGS)$_6$ (SEQ ID NO: 161) to form a single-chain variable fragment; and (b) each of the second polypeptide chain and the third polypeptide chain comprises in the N-terminal to C-terminal direction: (i) a heavy chain variable domain of the first immunoglobulin that is capable of specifically binding to the first epitope; and (ii) a heavy chain constant domain of the first immunoglobulin; and wherein the heavy chain variable domain of the first immunoglobulin is selected from the group consisting of: SEQ ID NO: 2, SEQ ID NO: 3, SEQ ID NO: 4, SEQ ID NO: 5, SEQ ID NO: 6, SEQ ID NO: 7, and SEQ ID NO: 133; and/or the light chain variable domain of the first immunoglobulin is selected from the group consisting of: SEQ ID NO: 9, SEQ ID NO: 10, SEQ ID NO: 11, SEQ ID NO: 12, and SEQ ID NO: 13. In certain embodiments, the second immunoglobulin binds to CD3, CD4, CD8, CD20, CD19, CD21, CD23, CD46, CD80, HLA-DR, CD74, CD22, CD14, CD15, CD16, CD123, TCR gamma/delta, NKp46, KIR, or a small molecule DOTA hapten.

In one aspect, the present disclosure provides a recombinant nucleic acid sequence encoding any of the antibodies or antigen binding fragments described herein. In some embodiments, the recombinant nucleic acid sequence is selected from the group consisting of: SEQ ID NOs: 15, 17, 19, 21, 23, 25, 135 and 137.

In another aspect, the present disclosure provides a host cell or vector comprising any of the recombinant nucleic acid sequences disclosed herein.

In one aspect, the present disclosure provides a composition comprising an antibody or antigen binding fragment of the present technology and a pharmaceutically-acceptable carrier, wherein the antibody or antigen binding fragment is optionally conjugated to an agent selected from the group consisting of isotopes, dyes, chromagens, contrast agents, drugs, toxins, cytokines, enzymes, enzyme inhibitors, hormones, hormone antagonists, growth factors, radionuclides, metals, liposomes, nanoparticles, RNA, DNA or any combination thereof.

In some embodiments of the bispecific antibody or antigen binding fragment of the present technology, the bispecific antibody binds to T cells, B-cells, myeloid cells, plasma cells, or mast-cells. Additionally or alternatively, in some embodiments, the bispecific antibody or antigen binding fragment binds to CD3, CD4, CD8, CD20, CD19, CD21, CD23, CD46, CD80, HLA-DR, CD74, CD22, CD14, CD15, CD16, CD123, TCR gamma/delta, NKp46, KIR, or a small molecule DOTA hapten. The small molecule DOTA hapten may be selected from the group consisting of DOTA, DOTA-Bn, DOTA-desferrioxamine, DOTA-Phe-Lys(HSG)-D-Tyr-Lys(HSG)-NH$_2$, Ac-Lys(HSG)D-Tyr-Lys(HSG)-Lys(Tscg-Cys)-NH$_2$, DOTA-D-Asp-D-Lys(HSG)-D-Asp-D-Lys(HSG)-NH$_2$; DOTA-D-Glu-D-Lys(HSG)-D-Glu-D-Lys(HSG)-NH$_2$, DOTA-D-Tyr-D-Lys(HSG)-D-Glu-D-Lys(HSG)-NH$_2$, DOTA-D-Ala-D-Lys(HSG)-D-Glu-D-Lys(HSG)-NH$_2$, DOTA-D-Phe-D-Lys(HSG)-D-Tyr-D-Lys(HSG)-NH$_2$, Ac-D-Phe-D-Lys(DOTA)-D-Tyr-D-Lys(DOTA)-NH$_2$, Ac-D-Phe-D-Lys(DTPA)-D-Tyr-D-Lys(DTPA)-NH$_2$, Ac-D-Phe-D-Lys(Bz-DTPA)-D-Tyr-D-Lys(Bz-DTPA)-NH$_2$, Ac-D-Lys(HSG)-D-Tyr-D-Lys(HSG)-D-Lys(Tscg-Cys)-NH$_2$, DOTA-D-Phe-D-Lys(HSG)-D-Tyr-D-Lys(HSG)-D-Lys(Tscg-Cys)-NH$_2$, (Tscg-Cys)-D-Phe-D-Lys(HSG)-D-Tyr-D-Lys(HSG)-D-Lys(DOTA)-NH$_2$, Tscg-D-Cys-D-Glu-D-Lys(HSG)-D-Glu-D-Lys(HSG)-NH$_2$, (Tscg-Cys)-D-Glu-D-Lys(HSG)-D-Glu-D-Lys(HSG)-NH$_2$, Ac-D-Cys-D-Lys(DOTA)-D-Tyr-D-Ala-D-Lys(DOTA)-D-Cys-NH$_2$, Ac-D-Cys-D-Lys(DTPA)-D-Tyr-D-Lys(DTPA)-NH$_2$, Ac-D-Lys(DTPA)-D-Tyr-D-Lys(DTPA)-D-Lys(Tscg-Cys)-NH$_2$, and Ac-D-Lys(DOTA)-D-Tyr-D-Lys(DOTA)-D-Lys(Tscg-Cys)-NH$_2$.

In another aspect, the present disclosure provides a method for treating a CD33 associated cancer or Alzheimer's disease in a subject in need thereof, comprising administering to the subject an effective amount of any one of the antibodies or antigen binding fragments disclosed herein. In certain embodiments, the antibody comprises a HC amino acid sequence and a LC amino acid sequence selected from the group consisting of: SEQ ID NO: 16 and SEQ ID NO: 14 (chHIM34×CD3 BsAb); SEQ ID NO: 20 and SEQ ID NO: 18 (BC249—hHIM34×CD3 BsAb); SEQ ID NO: 136 and SEQ ID NO: 134 (BC275—hHIM34×CD3 BsAb); SEQ ID NO: 22 and SEQ ID NO: 18 (BC267—hHIM34×CD3 BsAb); SEQ ID NO: 22 and SEQ ID NO: 24 (BC268—hHIM34×CD3 BsAb); SEQ ID NO: 20 and SEQ ID NO: 26 (VL3VH5×mC825); SEQ ID NO: 20 and SEQ ID NO: 27 (VL3VH5×hC825); SEQ ID NO: 22 and SEQ ID NO: 26 (VL3VH6×mC825); SEQ ID NO: 22 and SEQ ID NO: 27 (VL3VH6×hC825); SEQ ID NO: 22 and SEQ ID NO: 28 (VL4VH6×mC825); SEQ ID NO: 22 and SEQ ID NO: 29 (VL4VH6×hC825), SEQ ID NO: 139 and SEQ ID NO: 138 (mouse VL-mouseVH×mC825); and SEQ ID NO: 141 and SEQ ID NO: 140 (mouse VL-mouseVH×hC825), respectively, wherein the antibody specifically binds to CD33. In some embodiments, the antibody or antigen binding fragment comprises an amino acid sequence selected from any one of SEQ ID NOs. 30-113 or 142-153.

In some embodiments, the CD33 associated cancer is AML, bi-phenotypic leukemia, bilineage leukemia, myelodysplastic syndromes, chronic myelomonocytic leukemia, myeloid blast criss of chronic myeloid leukemia, or acute lymphoblastic leukemia.

Additionally or alternatively, in some embodiments of the method, the antibody or antigen binding fragment is administered to the subject separately, sequentially or simultaneously with an additional therapeutic agent. Examples of additional therapeutic agents include one or more of alkylating agents, platinum agents, taxanes, vinca agents, anti-estrogen drugs, aromatase inhibitors, ovarian suppression agents, VEGF/VEGFR inhibitors, EGF/EGFR inhibitors, PARP inhibitors, cytostatic alkaloids, cytotoxic antibiotics, antimetabolites, endocrine/hormonal agents, bisphosphonate therapy agents.

In another aspect, the present disclosure provides a method for detecting a tumor in a subject in vivo comprising (a) administering to the subject an effective amount of an antibody or antigen binding fragment of the present technology, wherein the antibody or antigen binding fragment is configured to localize to a tumor expressing CD33 and is labeled with a radioisotope; and (b) detecting the presence of a tumor in the subject by detecting radioactive levels emitted by the antibody or antigen binding fragment that are higher than a reference value. In some embodiments, the subject is diagnosed with or is suspected of having cancer. Radioactive levels emitted by the antibody or antigen binding fragment may be detected using positron emission tomography or single photon emission computed tomography.

Additionally or alternatively, in some embodiments, the method further comprises administering to the subject an effective amount of an immunoconjugate comprising an antibody or antigen binding fragment of the present technology conjugated to a radionuclide. In some embodiments, the radionuclide is an alpha particle-emitting isotope, a beta particle-emitting isotope, an Auger-emitter, or any combination thereof. Examples of beta particle-emitting isotopes include $^{86}$Y, $^{90}$Y, $^{89}$Sr, $^{165}$Dy, $^{186}$Re, $^{188}$Re, $^{177}$Lu, and $^{67}$Cu. In some embodiments of the method, nonspecific FcR-dependent binding in normal tissues is eliminated or reduced (e.g., via N297A mutation in Fc region, which results in aglycosylation).

Also disclosed herein are kits for the detection and/or treatment of CD33 associated cancers or Alzheimer's disease, comprising at least one immunoglobulin-related composition of the present technology (e.g., any antibody or antigen binding fragment described herein), or a functional variant (e.g., substitutional variant) thereof and instructions for use. In certain embodiments, the immunoglobulin-related composition is coupled to one or more detectable labels. In one embodiment, the one or more detectable labels comprise a radioactive label, a fluorescent label, or a chromogenic label.

Additionally or alternatively, in some embodiments, the kit further comprises a secondary antibody that specifically binds to an anti-CD33 immunoglobulin-related composition described herein. In some embodiments, the secondary antibody is coupled to at least one detectable label selected from the group consisting of a radioactive label, a fluorescent label, or a chromogenic label.

In another aspect, the present disclosure provides a method for selecting a subject for pretargeted radioimmunotherapy comprising (a) administering to the subject an effective amount of a complex comprising a radiolabeled DOTA hapten and a bispecific antibody or antigen binding fragment of the present technology that binds to the radiolabeled DOTA hapten and a CD33 antigen, wherein the complex is configured to localize to a tumor expressing the CD33 antigen recognized by the bispecific antibody or antigen binding fragment of the complex; (b) detecting radioactive levels emitted by the complex; and (c) selecting the subject for pretargeted radioimmunotherapy when the radioactive levels emitted by the complex are higher than a reference value.

In one aspect, the present disclosure provides a method for increasing tumor sensitivity to radiation therapy in a subject diagnosed with a CD33-associated cancer comprising administering to the subject an effective amount of a complex comprising a radiolabeled-DOTA hapten and a bispecific antibody or antigen binding fragment of the present technology that recognizes and binds to the radiolabeled-DOTA hapten and a CD33 antigen target, wherein the complex is configured to localize to a tumor expressing the CD33 antigen target recognized by the bispecific antibody or antigen binding fragment of the complex.

In another aspect, the present disclosure provides a method for treating cancer in a subject in need thereof comprising administering to the subject an effective amount of a complex comprising a radiolabeled-DOTA hapten and a bispecific antibody or antigen binding fragment of the present technology that recognizes and binds to the radiolabeled-DOTA hapten and a CD33 antigen target, wherein the complex is configured to localize to a tumor expressing the CD33 antigen target recognized by the bispecific antibody or antigen binding fragment of the complex.

In any of the above embodiments of the methods disclosed herein, the complex is administered intravenously, intramuscularly, intraarterially, intrathecally, intracapsularly, intraorbitally, intradermally, intraperitoneally, transtracheally, subcutaneously, intracerebroventricularly, orally, intratumorally, or intranasally. In some embodiments of the methods disclosed herein, the subject is human. Additionally or alternatively, in any of the above embodiments of the methods disclosed herein, the radiolabeled-DOTA hapten comprises $^{213}$Bi, $^{211}$At, $^{225}$Ac, $^{152}$Dy, $^{212}$Bi, $^{223}$Ra, $^{219}$Rn, $^{215}$Po, $^{211}$Bi, $^{221}$Fr, $^{217}$At, $^{255}$Fm, $^{86}$Y, $^{90}$Y, $^{89}$Sr, $^{165}$Dy, $^{186}$Re, $^{188}$Re, $^{177}$Lu, $^{67}$Cu, $^{111}$In, $^{67}$Ga, $^{51}$Cr, $^{58}$Co, $^{99m}$Tc, $^{103m}$Rh, $^{195m}$Pt, $^{119}$Sb, $^{161}$Ho, $^{189m}$Os, $^{192}$Ir, $^{201}$Tl, $^{203}$Pb, $^{68}$Ga, $^{227}$Th, or $^{64}$Cu, and optionally comprises an alpha particle-emitting isotope, a beta particle-emitting isotope, or an Auger-emitter.

In one aspect, the present disclosure provides a method for increasing tumor sensitivity to radiation therapy in a subject diagnosed with a CD33-associated cancer comprising (a) administering an effective amount of an anti-DOTA bispecific antibody or antigen binding fragment of the present technology to the subject, wherein the anti-DOTA bispecific antibody or antigen binding fragment is configured to localize to a tumor expressing a CD33 antigen target; and (b) administering an effective amount of a radiolabeled-DOTA hapten to the subject, wherein the radiolabeled-DOTA hapten is configured to bind to the anti-DOTA bispecific antibody or antigen binding fragment. In another aspect, the present disclosure provides a method for treating cancer in a subject in need thereof comprising (a) administering an effective amount of an anti-DOTA bispecific antibody or antigen binding fragment of the present technology to the subject, wherein the anti-DOTA bispecific antibody or antigen binding fragment is configured to localize to a tumor expressing a CD33 antigen target; and (b) administering an effective amount of a radiolabeled-DOTA hapten to the subject, wherein the radiolabeled-DOTA hapten is configured to bind to the anti-DOTA bispecific antibody or antigen binding fragment. In some embodiments, the methods of the present technology further comprise administering an effective amount of a clearing agent to the subject prior to administration of the radiolabeled-DOTA hapten.

Additionally or alternatively, in any of the above embodiments of the methods disclosed herein, the radiolabeled-DOTA hapten comprises $^{213}$Bi, $^{211}$At, $^{225}$Ac, $^{152}$Dy, $^{212}$Bi, $^{223}$Ra, $^{219}$Rn, $^{215}$Po, $^{211}$Bi, $^{221}$Fr, $^{217}$At, $^{255}$Fm, $^{86}$Y, $^{90}$Y, $^{89}$Sr, $^{165}$Dy, $^{186}$Re, $^{188}$Re, $^{177}$Lu, $^{67}$Cu, $^{111}$In, $^{67}$Ga, $^{51}$Cr, $^{58}$Co, $^{99m}$Tc, $^{103m}$Rh, $^{195m}$Pt, $^{119}$Sb, $^{161}$Ho, $^{189m}$Os, $^{192}$Ir, $^{201}$Tl, $^{203}$Pb, $^{68}$Ga, $^{227}$Th, or $^{64}$Cu, and optionally comprises an alpha particle-emitting isotope, a beta particle-emitting isotope, or an Auger-emitter. In any of the above embodiments of the methods disclosed herein, the subject is human.

BRIEF DESCRIPTION OF THE DRAWINGS

FIG. 2 shows a list of existing anti-CD33 antibodies and their domain specificity, as indicated by their ability to bind to the full length CD33 protein and/or the short isoform of CD33.

FIG. 8 shows the amino acid sequences of the murine and humanized HIM34 heavy chain variable domains (SEQ ID NOs: 1-7 and 133). HIM34_VH-1, HIM34_VH-2, HIM_34_VH-3, HIM34_VH-4, HIM34_VH-5, HIM34-VH-6, HIM-34-VH-7 were 7 versions of humanized HIM34 heavy chain variable domain. $V_H$-CDR1, $V_H$-CDR2, and $V_H$-CDR3 sequences are shown in boldface.

FIG. 9 shows the amino acid sequences of the murine and humanized HIM34 light chain variable domains (SEQ ID NOs: 8-13). HIM34_VL-1, HIM34_VL-2, HIM_34_VL-3, HIM34_VL-4, and HIM34_VL-5 were 5 versions of humanized HIM34 light chain variable domain. $V_L$-CDR1, $V_L$-CDR2, and $V_L$-CDR3 sequences are shown in boldface.

FIGS. 10(A) and 10(B) show the amino acid and nucleotide sequences of the light chain and the heavy chain of chHIM34 BsAb (SEQ ID NOs: 14-17), respectively. The signal peptide is underlined, the variable domains of the chimeric anti-CD33 antibody are indicated in boldface font, and linker sequences are italicized and underlined. Also disclosed are the amino acid sequences for the $V_H$ and $V_L$ domains of chHIM34 BsAb (SEQ ID NOs: 114-115).

FIGS. 11(A) and 11(B) show the amino acid and nucleotide sequences of the light chain and the heavy chain of the humanized HIM34×CD3 BsAb, BC249 (SEQ ID NOs: 18-21), respectively. FIGS. 11(C) and 11(D) show the amino acid and nucleotide sequences of the light chain and the heavy chain of the humanized HIM34×CD3 BsAb, BC275 (SEQ ID NOs: 134-137), respectively. The signal peptide is underlined, the variable domains of the humanized anti-CD33 antibody are indicated in boldface font, and linker sequences are italicized and underlined.

FIGS. 12(A) and 12(B) show the amino acid and nucleotide sequences of the light chain and the heavy chain of the humanized HIM34×CD3 BsAb, BC267 (SEQ ID NOs: 18, 19, 22, and 23), respectively. The signal peptide is underlined, the variable domains of the humanized anti-CD33 antibody are indicated in boldface font, and linker sequences are italicized and underlined.

FIGS. 13(A) and 13(B) show the amino acid and nucleotide sequences of the light chain and the heavy chain of the humanized HIM34×CD3 BsAb, BC268 (SEQ ID NOs: 24, 25, 22, and 23), respectively. The signal peptide is underlined, the variable domains of the humanized anti-CD33 antibody are indicated in boldface font, and linker sequences are italicized and underlined.

FIGS. 14(A)-14(F) show the amino acid sequences of the light chain and heavy chain of humanized HIM34×C825 (anti-DOTA) BsAbs of the IgG-scFv format. The light chain amino acid sequences are shown in SEQ ID NOs: 26-29, and the heavy chain amino acid sequences are shown in SEQ ID NOs: 20 and 22. The signal peptide is underlined, the variable domains of the humanized anti-CD33 antibody are indicated in boldface font, and linker sequences are italicized and underlined.

FIGS. 14(G)-14(H) show the amino acid sequences of the light chain and heavy chain of murine HIM34×C825 (anti-DOTA) BsAbs of the IgG-scFv format. The light chain amino acid sequences are shown in SEQ ID NOs: 138 and 140, and the heavy chain amino acid sequences are shown in SEQ ID NOs: 139 and 141. The signal peptide is underlined, the variable domains of the mouse anti-CD33 antibody are indicated in boldface font, and linker sequences are italicized and underlined.

FIGS. 15(A)-15(BB) show the amino acid sequences of the humanized HIM34×C825 (anti-DOTA) BsAbs of the single-chain bispecific tandem fragment variable (scBsTaFv) format (SEQ ID NOs: 30-113). The signal peptide is underlined, the variable domains of the humanized anti-CD33 antibody are indicated in boldface font, and linker sequences are italicized and underlined.

FIGS. 15(CC)-15(FF) show the amino acid sequences of the mouse HIM34×C825 (anti-DOTA) BsAbs of the single-chain bispecific tandem fragment variable (scBsTaFv) format (SEQ ID NOs: 142-153). The signal peptide is underlined, the variable domains of the mouse-based anti-CD33 antibody are indicated in boldface font, and linker sequences are italicized and underlined.

FIGS. 16(A) and 16(B) show a summary of the characteristics, including binding kinetics, of the chimeric and humanized HIM34 BsAbs.

DETAILED DESCRIPTION

Figure 1:
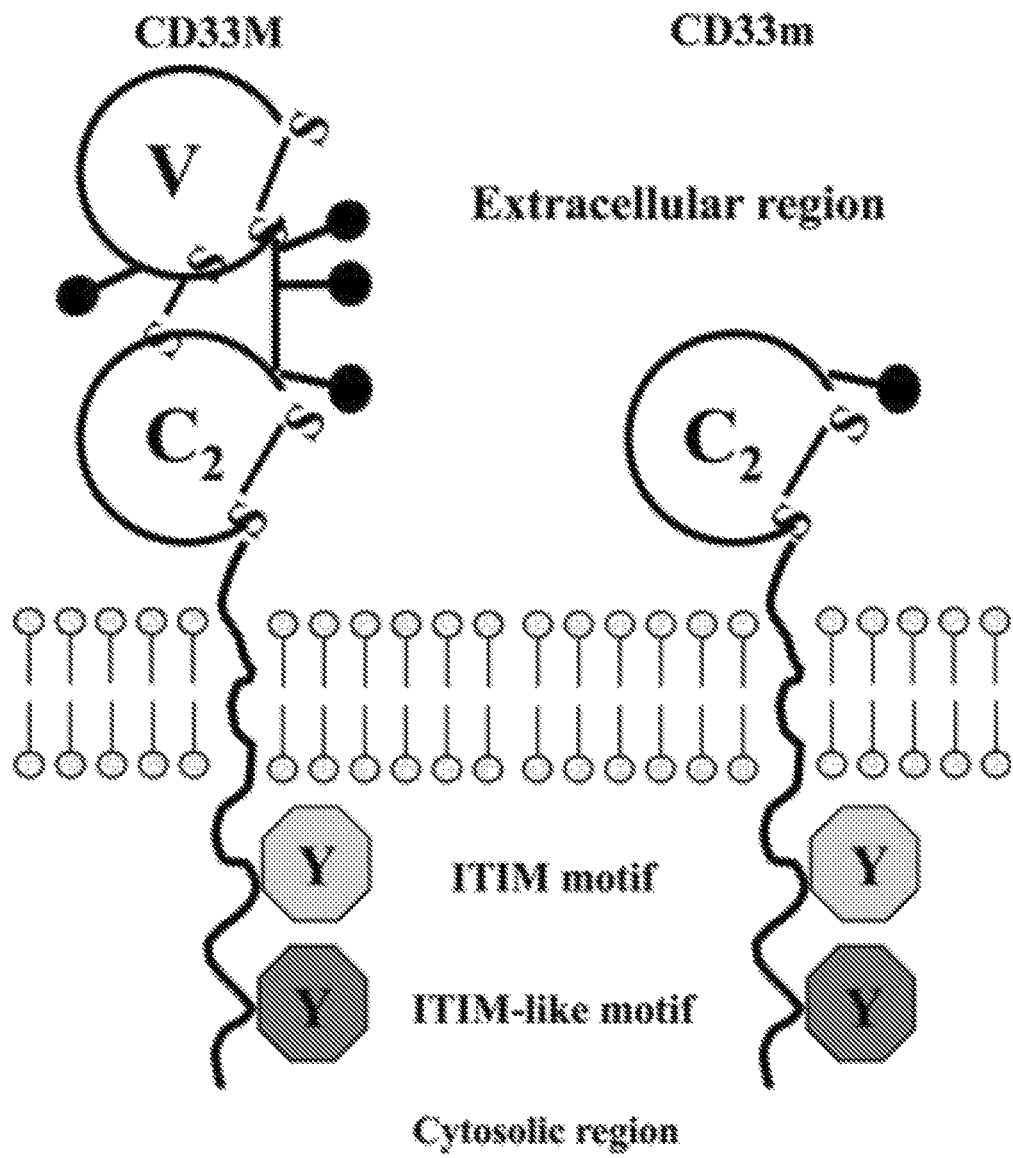
FIG. 1 shows the schematic structure of the CD33 isoforms. The full length CD33 protein is shown on the left and the short isoform (the splice variant lacking the outer IgV domain) in shown on the right.

It is to be appreciated that certain aspects, modes, embodiments, variations and features of the present methods are described below in various levels of detail in order to provide a substantial understanding of the present technology.

The present disclosure generally provides immunoglobulin-related compositions (e.g., antibodies or antigen binding fragments thereof), which can specifically bind to CD33 polypeptides. The immunoglobulin-related compositions of the present technology are useful in methods for detecting or treating CD33-associated cancers or Alzheimer's disease in a subject in need thereof. Accordingly, the various aspects of the present methods relate to the preparation, characterization, and manipulation of anti-CD33 antibodies. The immunoglobulin-related compositions of the present technology are useful alone or in combination with additional therapeutic agents for treating cancer. In some embodiments, the immunoglobulin-related composition is a humanized antibody, a chimeric antibody, or a bispecific antibody.

In practicing the present methods, many conventional techniques in molecular biology, protein biochemistry, cell biology, immunology, microbiology and recombinant DNA are used. See, e.g., Sambrook and Russell eds. (2001) *Molecular Cloning: A Laboratory Manual*, 3rd edition; the series Ausubel et al. eds. (2007) *Current Protocols in Molecular Biology*; the series *Methods in Enzymology* (Academic Press, Inc., N.Y.); MacPherson et al. (1991) *PCR 1: A Practical Approach* (IRL Press at Oxford University Press); MacPherson et al. (1995) *PCR 2: A Practical Approach*; Harlow and Lane eds. (1999) *Antibodies, A Laboratory Manual*; Freshney (2005) *Culture of Animal Cells: A Manual of Basic Technique*, 5th edition; Gait ed. (1984) *Oligonucleotide Synthesis*; U.S. Pat. No. 4,683,195; Hames and Higgins eds. (1984) *Nucleic Acid Hybridization*; Anderson (1999) *Nucleic Acid Hybridization*; Hames and Higgins eds. (1984) *Transcription and Translation*; *Immobilized Cells and Enzymes* (IRL Press (1986)); Perbal (1984) *A Practical Guide to Molecular Cloning*; Miller and Calos eds. (1987) *Gene Transfer Vectors for Mammalian Cells* (Cold Spring Harbor Laboratory); Makrides ed. (2003) *Gene Transfer and Expression in Mammalian Cells*; Mayer and Walker eds. (1987) *Immunochemical Methods in Cell and Molecular Biology* (Academic Press, London); and Herzenberg et al. eds (1996) *Weir's Handbook of Experimental Immunology*. Methods to detect and measure levels of polypeptide gene expression products (i.e., gene translation level) are well-known in the art and include the use of polypeptide detection methods such as antibody detection and quantification techniques. (See also, Strachan & Read, *Human Molecular Genetics*, Second Edition. (John Wiley and Sons, Inc., NY, 1999)).

Definitions

Unless defined otherwise, all technical and scientific terms used herein generally have the same meaning as commonly understood by one of ordinary skill in the art to which this technology belongs. As used in this specification and the appended claims, the singular forms "a", "an" and "the" include plural referents unless the content clearly dictates otherwise. For example, reference to "a cell" includes a combination of two or more cells, and the like. Generally, the nomenclature used herein and the laboratory procedures in cell culture, molecular genetics, organic chemistry, analytical chemistry and nucleic acid chemistry and hybridization described below are those well-known and commonly employed in the art.

As used herein, the term "about" in reference to a number is generally taken to include numbers that fall within a range of 1%, 5%, or 10% in either direction (greater than or less than) of the number unless otherwise stated or otherwise evident from the context (except where such number would be less than 0% or exceed 100% of a possible value).

As used herein, the "administration" of an agent or drug to a subject includes any route of introducing or delivering to a subject a compound to perform its intended function. Administration can be carried out by any suitable route, including but not limited to, orally, intranasally, parenterally (intravenously, intramuscularly, intraperitoneally, or subcutaneously), rectally, intrathecally, intratumorally or topically. Administration includes self-administration and the administration by another.

An "adjuvant" refers to one or more substances that cause stimulation of the immune system. In this context, an adjuvant is used to enhance an immune response to one or more vaccine antigens or antibodies. An adjuvant may be administered to a subject before, in combination with, or after administration of the vaccine. Examples of chemical compounds used as adjuvants include aluminum compounds, oils, block polymers, immune stimulating complexes, vitamins and minerals (e.g., vitamin E, vitamin A, selenium, and vitamin B12), Quil A (saponins), bacterial and fungal cell wall components (e.g., lipopolysaccharides, lipoproteins, and glycoproteins), hormones, cytokines, and co-stimulatory factors.

As used herein, the term "antibody" collectively refers to immunoglobulins or immunoglobulin-like molecules including by way of example and without limitation, IgA, IgD, IgE, IgG and IgM, combinations thereof, and similar molecules produced during an immune response in any vertebrate, for example, in mammals such as humans, goats, rabbits and mice, as well as non-mammalian species, such as shark immunoglobulins. As used herein, "antibodies" (includes intact immunoglobulins) and "antigen binding fragments" specifically bind to a molecule of interest (or a group of highly similar molecules of interest) to the substantial exclusion of binding to other molecules (for example, antibodies and antibody fragments that have a binding constant for the molecule of interest that is at least $10^3$ $M^{-1}$ greater, at least $10^4 M^{-1}$ greater or at least $10^5$ $M^{-1}$ greater than a binding constant for other molecules in a biological sample). The term "antibody" also includes genetically engineered forms such as chimeric antibodies (for example, humanized murine antibodies), heteroconjugate antibodies (such as, bispecific antibodies). See also, Pierce Catalog and Handbook, 1994-1995 (Pierce Chemical Co., Rockford, Ill.); Kuby, J., *Immunology*, $3^{rd}$ Ed., W.H. Freeman & Co., New York, 1997.

More particularly, antibody refers to a polypeptide ligand comprising at least a light chain immunoglobulin variable region or heavy chain immunoglobulin variable region which specifically recognizes and binds an epitope of an antigen. Antibodies are composed of a heavy and a light chain, each of which has a variable region, termed the variable heavy ($V_H$) region and the variable light ($V_L$) region. Together, the $V_H$ region and the $V_L$ region are responsible for binding the antigen recognized by the antibody. Typically, an immunoglobulin has heavy (H) chains and light (L) chains interconnected by disulfide bonds. There are two types of light chain, lambda (λ) and kappa (κ). There are five main heavy chain classes (or isotypes) which determine the functional activity of an antibody molecule: IgM, IgD, IgG, IgA and IgE. Each heavy and light chain contains a constant region and a variable region, (the regions are also known as "domains"). In combination, the heavy and the light chain variable regions specifically bind the antigen. Light and heavy chain variable regions contain a "framework" region interrupted by three hypervariable regions, also called "complementarity-determining regions" or "CDRs". The extent of the framework region and CDRs have been defined (see, Kabat et al., *Sequences of Proteins of Immunological Interest*, U.S. Department of Health and Human Services, 1991, which is hereby incorporated by reference). The Kabat database is now maintained online. The sequences of the framework regions of different light or heavy chains are relatively conserved within a species. The framework region of an antibody, that is the combined framework regions of the constituent light and heavy chains, largely adopt a β-sheet conformation and the CDRs form loops which connect, and in some cases form part of, the β-sheet structure. Thus, framework regions act to form a scaffold that provides for positioning the CDRs in correct orientation by inter-chain, non-covalent interactions.

The CDRs are primarily responsible for binding to an epitope of an antigen. The CDRs of each chain are typically referred to as CDR1, CDR2, and CDR3, numbered sequentially starting from the N-terminus, and are also typically identified by the chain in which the particular CDR is located. Thus, a $V_H$ CDR3 is located in the variable domain of the heavy chain of the antibody in which it is found, whereas a $V_L$ CDR1 is the CDR1 from the variable domain of the light chain of the antibody in which it is found. An antibody that binds CD33 protein will have a specific $V_H$ region and the $V_L$ region sequence, and thus specific CDR sequences. Antibodies with different specificities (i.e. different combining sites for different antigens) have different CDRs. Although it is the CDRs that vary from antibody to antibody, only a limited number of amino acid positions within the CDRs are directly involved in antigen binding. These positions within the CDRs are called specificity determining residues (SDRs). "Immunoglobulin-related compositions" as used herein, refers to antibodies (including monoclonal antibodies, polyclonal antibodies, humanized antibodies, chimeric antibodies, recombinant antibodies, multispecific antibodies, bispecific antibodies, etc.) as well as antibody fragments. An antibody or antigen binding fragment thereof specifically binds to an antigen.

As used herein, the term "antibody-related polypeptide" means antigen-binding antibody fragments, including single-chain antibodies, that can comprise the variable region(s) alone, or in combination, with all or part of the following polypeptide elements: hinge region, $CH_1$, $CH_2$, and $CH_3$ domains of an antibody molecule. Also included in the technology are any combinations of variable region(s) and hinge region, $CH_1$, $CH_2$, and $CH_3$ domains. Antibody-related molecules useful in the present methods, e.g., but are not limited to, Fab, Fab' and F(ab')$_2$, Fd, single-chain Fvs (scFv), single-chain antibodies, disulfide-linked Fvs (sdFv) and fragments comprising either a $V_L$ or $V_H$ domain. Examples include: (i) a Fab fragment, a monovalent fragment consisting of the $V_L$, $V_H$, $C_L$ and $CH_1$ domains; (ii) a F(ab')$_2$ fragment, a bivalent fragment comprising two Fab fragments linked by a disulfide bridge at the hinge region; (iii) a Fd fragment consisting of the $V_H$ and $CH_1$ domains; (iv) a Fv fragment consisting of the $V_L$ and $V_H$ domains of a single arm of an antibody, (v) a dAb fragment (Ward et al., *Nature* 341: 544-546, 1989), which consists of a $V_H$ domain; and (vi) an isolated complementarity determining region (CDR). As such "antibody fragments" or "antigen binding fragments" can comprise a portion of a full length antibody, generally the antigen binding or variable region thereof. Examples of antibody fragments or antigen binding fragments include Fab, Fab', F(ab')$_2$, and Fv fragments; diabodies; linear antibodies; single-chain antibody molecules; and multispecific antibodies formed from antibody fragments.

"Bispecific antibody" or "BsAb", as used herein, refers to an antibody that can bind simultaneously to two targets that have a distinct structure, e.g., two different target antigens, two different epitopes on the same target antigen, or a hapten and a target antigen or epitope on a target antigen. A variety of different bispecific antibody structures are known in the art. In some embodiments, each antigen binding moiety in a bispecific antibody includes $V_H$ and/or $V_L$ regions; in some such embodiments, the $V_H$ and/or $V_L$ regions are those found in a particular monoclonal antibody. In some embodiments, the bispecific antibody contains two antigen binding moieties, each including $V_H$ and/or $V_L$ regions from different monoclonal antibodies. In some embodiments, the bispecific antibody contains two antigen binding moieties, wherein one of the two antigen binding moieties includes an immunoglobulin molecule having $V_H$ and/or $V_L$ regions that contain CDRs from a first monoclonal antibody, and the other antigen binding moiety includes an antibody fragment (e.g., Fab, F(ab'), F(ab')$_2$, Fd, Fv, dAB, scFv, etc.) having $V_H$ and/or $V_L$ regions that contain CDRs from a second monoclonal antibody.

As used herein, a "clearing agent" is an agent that binds to excess bispecific antibody that is present in the blood compartment of a subject to facilitate rapid clearance via kidneys. The use of the clearing agent prior to hapten administration (e.g., DOTA) facilitates better tumor-to-background ratios in pretargeted radioimmunotherapy (PRIT) systems. Examples of clearing agents include 500 kD-dextran-DOTA-Bn(Y) (Orcutt et al., *Mol Cancer Ther.* 11(6): 1365-1372 (2012)), 500 kD aminodextran-DOTA conjugate, antibodies against the pretargeting antibody, etc.

As used herein, the term "conjugated" refers to the association of two molecules by any method known to those in the art. Suitable types of associations include chemical bonds and physical bonds. Chemical bonds include, for example, covalent bonds and coordinate bonds. Physical bonds include, for instance, hydrogen bonds, dipolar interactions, van der Waal forces, electrostatic interactions, hydrophobic interactions and aromatic stacking.

As used herein, the term "diabodies" refers to small antibody fragments with two antigen-binding sites, which fragments comprise a heavy-chain variable domain ($V_H$) connected to a light-chain variable domain ($V_L$) in the same polypeptide chain ($V_H V_L$). By using a linker that is too short to allow pairing between the two domains on the same chain, the domains are forced to pair with the complementary domains of another chain and create two antigen binding sites. Diabodies are described more fully in, e.g., EP 404,097; WO 93/11161; and Hollinger et al., *Proc. Natl. Acad. Sci. USA*, 90: 6444-6448 (1993).

As used herein, the terms "single-chain antibodies" or "single-chain Fv (scFv)" refer to an antibody fusion molecule of the two domains of the Fv fragment, $V_L$ and $V_H$. Single-chain antibody molecules may comprise a polymer with a number of individual molecules, for example, dimer, trimer or other polymers. Furthermore, although the two domains of the $F_v$ fragment, $V_L$ and $V_H$, are coded for by separate genes, they can be joined, using recombinant methods, by a synthetic linker that enables them to be made as a single protein chain in which the $V_L$ and $V_H$ regions pair to form monovalent molecules (known as single-chain $F_v$ (scF$_v$)). Bird et al. (1988) *Science* 242:423-426 and Huston et al. (1988) *Proc. Natl. Acad Sci*. USA 85:5879-5883. Such single-chain antibodies can be prepared by recombinant techniques or enzymatic or chemical cleavage of intact antibodies.

Any of the above-noted antibody fragments are obtained using conventional techniques known to those of skill in the art, and the fragments are screened for binding specificity and neutralization activity in the same manner as are intact antibodies.

As used herein, an "antigen" refers to a molecule to which an antibody (or antigen binding fragment thereof) can selectively bind. The target antigen may be a protein, carbohydrate, nucleic acid, lipid, hapten, or other naturally occurring or synthetic compound. In some embodiments, the target antigen may be a polypeptide (e.g., a CD33 polypeptide). An antigen may also be administered to an animal to generate an immune response in the animal.

The term "antigen binding fragment" refers to a fragment of the whole immunoglobulin structure which possesses a part of a polypeptide responsible for binding to antigen. Examples of the antigen binding fragment useful in the present technology include scFv, (scFv)$_2$, scFvFc, Fab, Fab' and F(ab')$_2$, but are not limited thereto.

By "binding affinity" is meant the strength of the total noncovalent interactions between a single binding site of a molecule (e.g., an antibody) and its binding partner (e.g., an antigen or antigenic peptide). The affinity of a molecule X for its partner Y can generally be represented by the dissociation constant ($K_D$). Affinity can be measured by standard methods known in the art, including those described herein. A low-affinity complex contains an antibody that generally tends to dissociate readily from the antigen, whereas a high-affinity complex contains an antibody that generally tends to remain bound to the antigen for a longer duration.

As used herein, the term "biological sample" means sample material derived from living cells. Biological samples may include tissues, cells, protein or membrane extracts of cells, and biological fluids (e.g., ascites fluid or cerebrospinal fluid (CSF)) isolated from a subject, as well as tissues, cells and fluids present within a subject. Biological samples of the present technology include, but are not limited to, samples taken from breast tissue, renal tissue, the uterine cervix, the endometrium, the head or neck, the gallbladder, parotid tissue, the prostate, the brain, the pituitary gland, kidney tissue, muscle, the esophagus, the stomach, the small intestine, the colon, the liver, the spleen, the pancreas, thyroid tissue, heart tissue, lung tissue, the bladder, adipose tissue, lymph node tissue, the uterus, ovarian tissue, adrenal tissue, testis tissue, the tonsils, thymus, blood, hair, buccal, skin, serum, plasma, CSF, semen, prostate fluid, seminal fluid, urine, feces, sweat, saliva, sputum, mucus, bone marrow, lymph, and tears. Biological samples can also be obtained from biopsies of internal organs or from cancers. Biological samples can be obtained from subjects for diagnosis or research or can be obtained from non-diseased individuals, as controls or for basic research. Samples may be obtained by standard methods including, e.g., venous puncture and surgical biopsy. In certain embodiments, the biological sample is a tissue sample obtained by needle biopsy.

As used herein, the term "CDR-grafted antibody" means an antibody in which at least one CDR of an "acceptor" antibody is replaced by a CDR "graft" from a "donor" antibody possessing a desirable antigen specificity.

As used herein, the term "chimeric antibody" means an antibody in which the Fc constant region of a monoclonal antibody from one species (e.g., a mouse Fc constant region) is replaced, using recombinant DNA techniques, with an Fc constant region from an antibody of another species (e.g., a human Fc constant region). See generally, Robinson et al., PCT/US86/02269; Akira et al., European Patent Application 184,187; Taniguchi, European Patent Application 171,496; Morrison et al., European Patent Application 173,494; Neuberger et al., WO 86/01533; Cabilly et al. U.S. Pat. No. 4,816,567; Cabilly et al., European Patent Application 0125, 023; Better et al., *Science* 240: 1041-1043, 1988; Liu et al., *Proc. Natl. Acad. Sci. USA* 84: 3439-3443, 1987; Liu et al., J. Immunol 139: 3521-3526, 1987; Sun et al., *Proc. Natl. Acad. Sci. USA* 84: 214-218, 1987; Nishimura et al., *Cancer Res* 47: 999-1005, 1987; Wood et al., Nature 314: 446-449, 1885; and Shaw et al., *J. Natl. Cancer Inst*. 80: 1553-1559, 1988.

As used herein, the term "consensus FR" means a framework (FR) antibody region in a consensus immunoglobulin sequence. The FR regions of an antibody do not contact the antigen.

As used herein, a "control" is an alternative sample used in an experiment for comparison purpose. A control can be "positive" or "negative." For example, where the purpose of the experiment is to determine a correlation of the efficacy of a therapeutic agent for the treatment for a particular type of disease, a positive control (a compound or composition known to exhibit the desired therapeutic effect) and a negative control (a subject or a sample that does not receive the therapy or receives a placebo) are typically employed.

As used herein, the term "effective amount" refers to a quantity sufficient to achieve a desired therapeutic and/or prophylactic effect, e.g., an amount which results in the prevention of, or a decrease in a disease or condition described herein or one or more signs or symptoms associated with a disease or condition described herein. In the context of therapeutic or prophylactic applications, the amount of a composition administered to the subject will vary depending on the composition, the degree, type, and severity of the disease and on the characteristics of the individual, such as general health, age, sex, body weight and tolerance to drugs. The skilled artisan will be able to determine appropriate dosages depending on these and other factors. The compositions can also be administered in combination with one or more additional therapeutic compounds. In the methods described herein, the therapeutic compositions may be administered to a subject having one or more signs or symptoms of a disease or condition described herein. As used herein, a "therapeutically effective amount" of a composition refers to composition levels in which the physiological effects of a disease or condition are ameliorated or eliminated. A therapeutically effective amount can be given in one or more administrations.

As used herein, the term "effector cell" means an immune cell which is involved in the effector phase of an immune response, as opposed to the cognitive and activation phases of an immune response. Exemplary immune cells include a cell of a myeloid or lymphoid origin, e.g., lymphocytes (e.g., B cells and T cells including cytolytic T cells (CTLs)), killer cells, natural killer cells, macrophages, monocytes, eosinophils, neutrophils, polymorphonuclear cells, granulocytes, mast cells, and basophils. Effector cells express specific Fc receptors and carry out specific immune functions. An effector cell can induce antibody-dependent cell-mediated cytotoxicity (ADCC), e.g., a neutrophil capable of inducing ADCC. For example, monocytes, macrophages, neutrophils, eosinophils, and lymphocytes which express FcαR are involved in specific killing of target cells and presenting antigens to other components of the immune system, or binding to cells that present antigens.

As used herein, the term "epitope" means a protein determinant capable of specific binding to an antibody. Epitopes usually consist of chemically active surface groupings of molecules such as amino acids or sugar side chains and usually have specific three dimensional structural characteristics, as well as specific charge characteristics. Conformational and non-conformational epitopes are distinguished in that the binding to the former but not the latter is lost in the presence of denaturing solvents. In some embodiments, an "epitope" of the CD33 protein is a region of the protein to which the anti-CD33 antibodies of the present technology specifically bind. In some embodiments, the epitope is a conformational epitope or a non-conformational epitope. To screen for anti-CD33 antibodies which bind to an epitope, a routine cross-blocking assay such as that described in Antibodies, *A Laboratory Manual*, Cold Spring Harbor Laboratory, Ed Harlow and David Lane (1988), can be performed. This assay can be used to determine if an anti-CD33 antibody binds the same site or epitope as an anti-CD33 antibody of the present technology. Alternatively, or additionally, epitope mapping can be performed by methods known in the art. For example, the antibody sequence can be mutagenized such as by alanine scanning, to identify contact residues. In a different method, peptides corresponding to different regions of CD33 protein can be used in competition assays with the test antibodies or with a test antibody and an antibody with a characterized or known epitope.

As used herein, "expression" includes one or more of the following: transcription of the gene into precursor mRNA; splicing and other processing of the precursor mRNA to produce mature mRNA; mRNA stability; translation of the mature mRNA into protein (including codon usage and tRNA availability); and glycosylation and/or other modifications of the translation product, if required for proper expression and function.

As used herein, the term "gene" means a segment of DNA that contains all the information for the regulated biosynthesis of an RNA product, including promoters, exons, introns, and other untranslated regions that control expression.

"Homology" or "identity" or "similarity" refers to sequence similarity between two peptides or between two nucleic acid molecules. Homology can be determined by comparing a position in each sequence which may be aligned for purposes of comparison. When a position in the compared sequence is occupied by the same base or amino acid, then the molecules are homologous at that position. A degree of homology between sequences is a function of the number of matching or homologous positions shared by the sequences. A polynucleotide or polynucleotide region (or a polypeptide or polypeptide region) has a certain percentage (for example, at least 60%, 65%, 70%, 75%, 80%, 85%, 90%, 95%, 98% or 99%) of "sequence identity" to another sequence means that, when aligned, that percentage of bases (or amino acids) are the same in comparing the two sequences. This alignment and the percent homology or sequence identity can be determined using software programs known in the art. In some embodiments, default parameters are used for alignment. One alignment program is BLAST, using default parameters. In particular, programs are BLASTN and BLASTP, using the following default parameters: Genetic code=standard; filter=none; strand=both; cutoff=60; expect=10; Matrix=BLOSUM62; Descriptions=50 sequences; sort by =HIGH SCORE; Databases=non-redundant, GenBank+EMBL+DDBJ+PDB+GenBank CDS translations+SwissProtein+SPupdate+PIR. Details of these programs can be found at the National Center for Biotechnology Information. Biologically equivalent polynucleotides are those having the specified percent homology and encoding a polypeptide having the same or similar biological activity. Two sequences are deemed "unrelated" or "non-homologous" if they share less than 40% identity, or less than 25% identity, with each other.

As used herein, "humanized" forms of non-human (e.g., murine) antibodies are chimeric antibodies which contain minimal sequence derived from non-human immunoglobulin. For the most part, humanized antibodies are human immunoglobulins in which hypervariable region residues of the recipient are replaced by hypervariable region residues from a non-human species (donor antibody) such as mouse, rat, rabbit or nonhuman primate having the desired specificity, affinity, and capacity. In some embodiments, Fv framework region (FR) residues of the human immunoglobulin are replaced by corresponding non-human residues. Furthermore, humanized antibodies may comprise residues which are not found in the recipient antibody or in the donor antibody. These modifications are made to further refine antibody performance such as binding affinity. Generally, the humanized antibody will comprise substantially all of at least one, and typically two, variable domains (e.g., Fab, Fab', F(ab')$_2$, or Fv), in which all or substantially all of the hypervariable loops correspond to those of a non-human immunoglobulin and all or substantially all of the FR regions are those of a human immunoglobulin consensus FR sequence although the FR regions may include one or more amino acid substitutions that improve binding affinity. The number of these amino acid substitutions in the FR are typically no more than 6 in the H chain, and in the L chain, no more than 3. The humanized antibody optionally may also comprise at least a portion of an immunoglobulin constant region (Fc), typically that of a human immunoglobulin. For further details, see Jones et al., *Nature* 321: 522-525 (1986); Reichmann et al., *Nature* 332:323-329 (1988); and Presta, *Curr. Op. Struct. Biol.* 2:593-596 (1992). See e.g., Ahmed & Cheung, *FEBS Letters* 588(2):288-297 (2014).

As used herein, the term "hypervariable region" refers to the amino acid residues of an antibody which are responsible for antigen-binding. The hypervariable region generally comprises amino acid residues from a "complementarity determining region" or "CDR" (e.g., around about residues 24-34 (L1), 50-56 (L2) and 89-97 (L3) in the $V_L$, and around about 31-35B (H1), 50-65 (H2) and 95-102 (H3) in the $V_H$ (Kabat et al., *Sequences of Proteins of Immunological Interest*, 5th Ed. Public Health Service, National Institutes of Health, Bethesda, Md. (1991)) and/or those residues from a "hypervariable loop" (e.g., residues 26-32 (L1), 50-52 (L2) and 91-96 (L3) in the $V_L$, and 26-32 (H1), 52A-55 (H2) and 96-101 (H3) in the $V_H$ (Chothia and Lesk *J. Mol. Biol.* 196:901-917 (1987)).

As used herein, the terms "identical" or percent "identity", when used in the context of two or more nucleic acids or polypeptide sequences, refer to two or more sequences or subsequences that are the same or have a specified percentage of amino acid residues or nucleotides that are the same (i.e., about 60%, 65%, 70%, 75%, 80%, 85%, 90%, 91%, 92%, 93%, 94%, 95%, 96%, 97%, 98%, 99%, or higher identity over a specified region (e.g., nucleotide sequence encoding an antibody described herein or amino acid sequence of an antibody described herein)), when compared and aligned for maximum correspondence over a comparison window or designated region as measured using a BLAST or BLAST 2.0 sequence comparison algorithms with default parameters described below, or by manual alignment and visual inspection (e.g., NCBI web site). Such sequences are then said to be "substantially identical." This term also refers to, or can be applied to, the complement of a test sequence. The term also includes sequences that have deletions and/or additions, as well as those that have substitutions. In some embodiments, identity exists over a region that is at least about 25 amino acids or nucleotides in length, or 50-100 amino acids or nucleotides in length.

As used herein, the term "intact antibody" or "intact immunoglobulin" means an antibody that has at least two heavy (H) chain polypeptides and two light (L) chain polypeptides interconnected by disulfide bonds. Each heavy chain is comprised of a heavy chain variable region (abbreviated herein as HCVR or $V_H$) and a heavy chain constant region. The heavy chain constant region is comprised of three domains, $CH_1$, $CH_2$ and $CH_3$. Each light chain is comprised of a light chain variable region (abbreviated herein as LCVR or $V_L$) and a light chain constant region. The light chain constant region is comprised of one domain, $C_L$. The $V_H$ and $V_L$ regions can be further subdivided into regions of hypervariability, termed complementarity determining regions (CDR), interspersed with regions that are more conserved, termed framework regions (FR). Each $V_H$ and $V_L$ is composed of three CDRs and four FRs, arranged from amino-terminus to carboxyl-terminus in the following order: $FR_1$, $CDR_1$, $FR_2$, $CDR_2$, $FR_3$, $CDR_3$, $FR_4$. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (Clq) of the classical complement system.

As used herein, the terms "individual", "patient", or "subject" can be an individual organism, a vertebrate, a mammal, or a human. In some embodiments, the individual, patient or subject is a human.

The term "monoclonal antibody" as used herein refers to an antibody obtained from a population of substantially homogeneous antibodies, i.e., the individual antibodies comprising the population are identical except for possible naturally occurring mutations that may be present in minor amounts. For example, a monoclonal antibody can be an antibody that is derived from a single clone, including any eukaryotic, prokaryotic, or phage clone, and not the method by which it is produced. A monoclonal antibody composition displays a single binding specificity and affinity for a particular epitope. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. The modifier "monoclonal" indicates the character of the antibody as being obtained from a substantially homogeneous population of antibodies, and is not to be construed as requiring production of the antibody by any particular method. Monoclonal antibodies can be prepared using a wide variety of techniques known in the art including, e.g., but not limited to, hybridoma, recombinant, and phage display technologies. For example, the monoclonal antibodies to be used in accordance with the present methods may be made by the hybridoma method first described by Kohler et al., *Nature* 256:495 (1975), or may be made by recombinant DNA methods (See, e.g., U.S. Pat. No. 4,816, 567). The "monoclonal antibodies" may also be isolated from phage antibody libraries using the techniques described in Clackson et al., *Nature* 352:624-628 (1991) and Marks et al., *J. Mol. Biol.* 222:581-597 (1991), for example.

As used herein, the term "pharmaceutically-acceptable carrier" is intended to include any and all solvents, dispersion media, coatings, antibacterial and antifungal compounds, isotonic and absorption delaying compounds, and the like, compatible with pharmaceutical administration. Pharmaceutically-acceptable carriers and their formulations are known to one skilled in the art and are described, for example, in Remington's Pharmaceutical Sciences (20$^{th}$ edition, ed. A. Gennaro, 2000, Lippincott, Williams & Wilkins, Philadelphia, Pa.).

As used herein, the term "polyclonal antibody" means a preparation of antibodies derived from at least two (2) different antibody-producing cell lines. The use of this term includes preparations of at least two (2) antibodies that contain antibodies that specifically bind to different epitopes or regions of an antigen.

As used herein, the term "polynucleotide" or "nucleic acid" means any RNA or DNA, which may be unmodified or modified RNA or DNA. Polynucleotides include, without limitation, single- and double-stranded DNA, DNA that is a mixture of single- and double-stranded regions, single- and double-stranded RNA, RNA that is mixture of single- and double-stranded regions, and hybrid molecules comprising DNA and RNA that may be single-stranded or, more typically, double-stranded or a mixture of single- and double-stranded regions. In addition, polynucleotide refers to triple-stranded regions comprising RNA or DNA or both RNA and DNA. The term polynucleotide also includes DNAs or RNAs containing one or more modified bases and DNAs or RNAs with backbones modified for stability or for other reasons.

As used herein, the terms "polypeptide," "peptide" and "protein" are used interchangeably herein to mean a polymer comprising two or more amino acids joined to each other by peptide bonds or modified peptide bonds, i.e., peptide isosteres. Polypeptide refers to both short chains, commonly referred to as peptides, glycopeptides or oligomers, and to longer chains, generally referred to as proteins. Polypeptides may contain amino acids other than the 20 gene-encoded amino acids. Polypeptides include amino acid sequences modified either by natural processes, such as post-translational processing, or by chemical modification techniques that are well known in the art. Such modifications are well described in basic texts and in more detailed monographs, as well as in a voluminous research literature.

As used herein, "PRIT" or "pretargeted radioimmunotherapy" refers to a multistep process that resolves the slow blood clearance of tumor targeting antibodies, which contributes to undesirable toxicity to normal tissues such as bone marrow. In pre-targeting, a radionuclide or other diagnostic or therapeutic agent is attached to a small hapten. A pre-targeting bispecific antibody, which has binding sites for the hapten as well as a target antigen, is administered first. Unbound antibody is then allowed to clear from circulation and the hapten is subsequently administered.

As used herein, the term "recombinant" when used with reference, e.g., to a cell, or nucleic acid, protein, or vector, indicates that the cell, nucleic acid, protein or vector, has been modified by the introduction of a heterologous nucleic acid or protein or the alteration of a native nucleic acid or protein, or that the material is derived from a cell so modified. Thus, for example, recombinant cells express genes that are not found within the native (non-recombinant) form of the cell or express native genes that are otherwise abnormally expressed, under expressed or not expressed at all.

As used herein, the term "separate" therapeutic use refers to an administration of at least two active ingredients at the same time or at substantially the same time by different routes.

As used herein, the term "sequential" therapeutic use refers to administration of at least two active ingredients at different times, the administration route being identical or different. More particularly, sequential use refers to the whole administration of one of the active ingredients before administration of the other or others commences. It is thus possible to administer one of the active ingredients over several minutes, hours, or days before administering the other active ingredient or ingredients. There is no simultaneous treatment in this case.

As used herein, "specifically binds" refers to a molecule (e.g., an antibody or antigen binding fragment thereof) which recognizes and binds another molecule (e.g., an antigen), but that does not substantially recognize and bind other molecules. The terms "specific binding," "specifically binds to," or is "specific for" a particular molecule (e.g., a polypeptide, or an epitope on a polypeptide, as used herein, can be exhibited, for example, by a molecule having a $K_D$ for the molecule to which it binds to of about $10^{-4}M$, $10^{-5}M$, $10^{-6}$ M, $10^{-7}M$, $10^{-8}M$, $10^{-9}$ M, $10^{-10}$ M, $10^{-11}$ M, or $10^{-12}M$. The term "specifically binds" may also refer to binding where a molecule (e.g., an antibody or antigen binding fragment thereof) binds to a particular polypeptide (e.g., a CD33 polypeptide), or an epitope on a particular polypeptide, without substantially binding to any other polypeptide, or polypeptide epitope.

As used herein, the term "simultaneous" therapeutic use refers to the administration of at least two active ingredients by the same route and at the same time or at substantially the same time.

As used herein, the term "therapeutic agent" is intended to mean a compound that, when present in an effective amount, produces a desired therapeutic effect on a subject in need thereof.

"Treating" or "treatment" as used herein covers the treatment of a disease or disorder described herein, in a subject, such as a human, and includes: (i) inhibiting a disease or disorder, i.e., arresting its development; (ii) relieving a disease or disorder, i.e., causing regression of the disorder; (iii) slowing progression of the disorder; and/or (iv) inhibiting, relieving, or slowing progression of one or more symptoms of the disease or disorder. In some embodiments, treatment means that the symptoms associated with the disease are, e.g., alleviated, reduced, cured, or placed in a state of remission.

It is also to be appreciated that the various modes of treatment of disorders as described herein are intended to mean "substantial," which includes total but also less than total treatment, and wherein some biologically or medically relevant result is achieved. The treatment may be a continuous prolonged treatment for a chronic disease or a single, or few time administrations for the treatment of an acute condition.

Amino acid sequence modification(s) of the anti-CD33 antibodies described herein are contemplated. For example, it may be desirable to improve the binding affinity and/or other biological properties of the antibody. Amino acid sequence variants of an anti-CD33 antibody are prepared by introducing appropriate nucleotide changes into the antibody nucleic acid, or by peptide synthesis. Such modifications include, for example, deletions from, and/or insertions into and/or substitutions of, residues within the amino acid sequences of the antibody. Any combination of deletion, insertion, and substitution is made to obtain the antibody of interest, as long as the obtained antibody possesses the desired properties. The modification also includes the change of the pattern of glycosylation of the protein. The sites of greatest interest for substitutional mutagenesis include the hypervariable regions, but FR alterations are also contemplated. "Conservative substitutions" are shown in the Table below.

TABLE 1

Amino Acid Substitutions

| Original Residue | Exemplary Substitutions | Conservative Substitutions |
|---|---|---|
| Ala (A) | val; leu; ile | val |
| Arg (R) | lys; gln; asn | lys |
| Asn (N) | gln; his; asp, lys; arg | gln |
| Asp (D) | glu; asn | glu |
| Cys (C) | ser; ala | ser |
| Gln (Q) | asn; glu | asn |
| Glu (E) | asp; gln | asp |
| Gly (G) | ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | tyr |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

One type of substitutional variant involves substituting one or more hypervariable region residues of a parent antibody. A convenient way for generating such substitutional variants involves affinity maturation using phage display. Specifically, several hypervariable region sites (e.g., 6-7 sites) are mutated to generate all possible amino acid substitutions at each site. The antibody variants thus generated are displayed in a monovalent fashion from filamentous phage particles as fusions to the gene III product of M13 packaged within each particle. The phage-displayed variants are then screened for their biological activity (e.g., binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the antibody and the antigen. Such contact residues and neighboring residues are candidates for substitution according to the techniques elaborated herein. Once such variants are generated, the panel of variants is subjected to screening as described herein and antibodies with similar or superior properties in one or more relevant assays may be selected for further development.

CD33

CD33 (also known as Siglec-3, SIGLEC3, gp67, p67) is a 67 kDa plasma membrane protein that binds to sialic acid and is a member of the sialic acid-binding Ig-related lectin (SIGLEC) family of proteins. Siglec proteins are thought to be involved in diverse biological processes such as hematopoiesis, neuronal development and immunity (Vinson et al., *J. Biol. Chem.* 271:9267-9272 (1996)). Studies also suggest that Siglec proteins mediate cell adhesion/cell signaling through recognition of sialyated cell surface glycans (Kelm et al., *Glycoconj. J.* 13:913-926 (1996); Kelm et al., *Eur. J. Biochem.* 255:663-672 (1998); Vinson et al., *J. Biol. Chem.* 271:9267-9272 (1996)). The extracellular portion of CD33 contains two immunoglobulin domains (one IgV and one IgC2 domain) (FIG. 1). The intracellular portion of CD33 contains immunoreceptor tyrosine-based inhibitory motifs (ITIMs). In the immune response, CD33 may act as an inhibitory receptor upon ligand induced tyrosine phosphorylation by recruiting cytoplasmic phosphatase(s) that block signal transduction through dephosphorylation of signaling molecules.

CD33 is known to be expressed on myeloid cells. CD33 expression has also been reported on a number of malignant cells. Anti-CD33 agents are generally allocated in four groups: naked antibodies, antibody toxin conjugates, radionuclide conjugates, and bispecific antibodies. Although CD33 has been targeted for treatment of cancer, e.g., acute myeloid leukemia, no effective CD33-targeted treatments are currently on the market. Existing anti-CD33 agents suffer from, inter alia, inferior tumor antigen binding avidity and short in vivo half-life. Further, none of these antibodies can target the short isoform of CD33 (splice variant of CD33) (FIG. 2).

CD33 is expressed on the majority of leukemia cells, although nearly 50% of leukemia cells lack the outer IgV domain because of the rs12459419 polymorphism (*J. Clin Oncol.* 35(23):2674-2682 (2017)). These splice variants, which account for almost 50% of AML patients, do not benefit from current anti-CD33-IgV-domain antibody based therapies (e.g., Gemtuzumab Ozogamicin, lintuzumab, AMV564).

Immunoglobulin-Related Compositions of the Present Technology

The present technology describes methods and compositions for the generation and use of anti-CD33 immunoglobulin-related compositions (e.g., anti-CD33 antibodies or antigen binding fragments thereof). The anti-CD33 immunoglobulin-related compositions of the present disclosure may be useful in the diagnosis, or treatment of CD33-associated cancers or Alzheimer's disease. Anti-CD33 immunoglobulin-related compositions within the scope of the present technology include, e.g., but are not limited to, monoclonal, chimeric, humanized, bispecific antibodies and diabodies that specifically bind the target polypeptide, a homolog, derivative or a fragment thereof. The present disclosure also provides antigen binding fragments of any of the anti-CD33 antibodies disclosed herein, wherein the antigen binding fragment is selected from the group consisting of Fab, F(ab')2, Fab', scF$_v$, and F$_v$. The present technology discloses anti-CD33 bispecific antibody formats that address existing issues of inferior tumor antigen binding avidity and short in vivo half-life, in addition to binding both the full length CD33 protein as well as the short isoform of CD33. Importantly, the short isoform of CD33 is expressed on half of AML patients. In one aspect, the present technology provides chimeric and humanized variants of HIM34, including multi specific immunoglobulin-related compositions (e.g., bispecific antibody agents).

In one aspect, the present disclosure provides an antibody or antigen binding fragment thereof comprising a heavy chain immunoglobulin variable domain ($V_H$) and a light chain immunoglobulin variable domain ($V_L$), wherein (a) the $V_H$ comprises a $V_H$-CDR1 sequence of GYSFTDYN (SEQ ID NO: 154), a $V_H$-CDR2 sequence of IDPYKGGT (SEQ ID NO: 155), and a $V_H$-CDR3 sequence of AREMITAYYFDY (SEQ ID NO: 156), and (b) the $V_L$ comprises a $V_L$-CDR1 sequence of QDINKY (SEQ ID NO: 157), a $V_L$-CDR2 sequence of YAS (SEQ ID NO: 158), and a $V_L$-CDR3 sequence of LQYDNLLT (SEQ ID NO: 159).

In one aspect, the present technology provides an antibody or antigen binding fragment thereof comprising a heavy chain immunoglobulin variable domain ($V_H$) and a light chain immunoglobulin variable domain ($V_L$), wherein (a) the $V_H$ comprises an amino acid sequence selected from the group consisting of: SEQ ID NO: 2, SEQ ID NO: 3, SEQ ID NO: 4, SEQ ID NO: 5, SEQ ID NO: 6, SEQ ID NO: 7, and SEQ ID NO: 133; and/or (b) the $V_L$ comprises an amino acid sequence selected from the group consisting of: SEQ ID NO: 9, SEQ ID NO: 10, SEQ ID NO: 11, SEQ ID NO: 12, and SEQ ID NO: 13.

In any of the above embodiments, the antibody further comprises a Fc domain of any isotype, e.g., but are not limited to, IgG (including IgG1, IgG2, IgG3, and IgG4), IgA (including IgA$_1$ and IgA$_2$), IgD, IgE, or IgM, and IgY. Non-limiting examples of constant region sequences include:

```
Human IgD constant region, Uniprot: P01880
                                                        (SEQ ID NO: 116)
APTKAPDVFPIISGCRHPKDNSPVVLACLITGYHPTSVTVTWYMGTQSQPQRTFPEIQRR

DSYYMTSSQLSTPLQQWRQGEYKCVVQHTASKSKKEIFRWPESPKAQASSVPTAQPQA

EGSLAKATTAPATTRNTGRGGEEKKKEKEKEEQEERETKTPECPSHTQPLGVYLLTPAV

QDLWLRDKATFTCFVVGSDLKDAHLTWEVAGKVPTGGVEEGLLERHSNGSQSQHSRL

TLPRSLWNAGTSVTCTLNHPSLPPQRLMALREPAAQAPVKLSLNLLASSDPPEAASWLL

CEVSGFSPPNILLMWLEDQREVNTSGFAPARPPPQPGSTTFWAWSVLRVPAPPSPQPATY

TCVVSHEDSRTLLNASRSLEVSYVTDHGPMK

Human IgG1 constant region, Uniprot: P01857
                                                        (SEQ ID NO: 117)
ASTKGPSVFPLAPSSKSTSGGTAALGCLVKDYFPEPVTVSWNSGALTSGVHTFPAVLQSS

GLYSLSSVVTVPSSSLGTQTYICNVNHKPSNTKVDKKVEPKSCDKTHTCPPCPAPELLGG
```

-continued

PSVFLEPPKPKDTLMISRTPEVTCVVVDVSHEDPEVKFNWYVDGVEVHNAKTKPREEQY

NSTYRVVSVLTVLHQDWLNGKEYKCKVSNKALPAPIEKTISKAKGQPREPQVYTLPPSR

DELTKNQVSLTCLVKGFYPSDIAVEWESNGQPENNYKTTPPVLDSDGSFFLYSKLTVDK

SRWQQGNVFSCSVMHEALHNHYTQKSLSLSPGK

Human IgG2 constant region, Uniprot: P01859
(SEQ ID NO: 118)
ASTKGPSVFPLAPCSRSTSESTAALGCLVKDYFPEPVTVSWNSGALTSGVHTFPAVLQSS

GLYSLSSVVTVPSSNFGTQTYTCNVDHKPSNTKVDKTVERKCCVECPPCPAPPVAGPSV

FLFPPKPKDTLMISRTPEVTCVVVDVSHEDPEVQFNWYVDGVEVHNAKTKPREEQFNST

FRVVSVLTVVHQDWLNGKEYKCKVSNKGLPAPIEKTISKTKGQPREPQVYTLPPSREEM

TKNQVSLTCLVKGFYPSDISVEWESNGQPENNYKTTPPMLDSDGSFFLYSKLTVDKSRW

QQGNVFSCSVMHEALHNHYTQKSLSLSPGK

Human IgG3 constant region, Uniprot: P01860
(SEQ ID NO: 119)
ASTKGPSVFPLAPCSRSTSGGTAALGCLVKDYFPEPVTVSWNSGALTSGVHTFPAVLQSS

GLYSLSSVVTVPSSSLGTQTYTCNVNHKPSNTKVDKRVELKTPLGDTTHTCPRCPEPKSC

DTPPPCPRCPEPKSCDTPPPCPRCPEPKSCDTPPPCPRCPAPELLGGPSVFLFPPKPKDTLMI

SRTPEVTCVVVDVSHEDPEVQFKWYVDGVEVHNAKTKPREEQYNSTFRVVSVLTVLHQ

DWLNGKEYKCKVSNKALPAPIEKTISKTKGQPREPQVYTLPPSREEMTKNQVSLTCLVK

GFYPSDIAVEWESSGQPENNYNTTPPMLDSDGSFFLYSKLTVDKSRWQQGNIFSCSVMH

EALHNRFTQKSLSLSPGK

Human IgM constant region, Uniprot: P01871
(SEQ ID NO: 120)
GSASAPTLFPLVSCENSPSDTSSVAVGCLAQDFLPDSITLSWKYKNNSDISSTRGFPSVLR

GGKYAATSQVLLPSKDVMQGTDEHVVCKVQHPNGNKEKNVPLPVIAELPPKVSVFVPP

RDGFFGNPRKSKLICQATGFSPRQIQVSWLREGKQVGSGVTTDQVQAEAKESGPTTYKV

TSTLTIKESDWLGQSMFTCRVDHRGLTFQQNASSMCVPDQDTAIRVFAIPPSFASIFLTKS

TKLTCLVTDLTTYDSVTISWTRQNGEAVKTHTNISESHPNATFSAVGEASICEDDWNSGE

RFTCTVTHTDLPSPLKQTISRPKGVALHRPDVYLLPPAREQLNLRESATITCLVTGFSPAD

VFVQWMQRGQPLSPEKYVTSAPMPEPQAPGRYFAHSILTVSEEEWNTGETYTCVAHEA

LPNRVTERTVDKSTGKPTLYNVSLVMSDTAGTCY

Human IgG4 constant region, Uniprot: P01861
(SEQ ID NO: 121)
ASTKGPSVFPLAPCSRSTSESTAALGCLVKDYFPEPVTVSWNSGALTSGVHTFPAVLQSS

GLYSLSSVVTVPSSSLGTKTYTCNVDHKPSNTKVDKRVESKYGPPCPSCPAPEFLGGPSV

FLFPPKPKDTLMISRTPEVTCVVVDVSQEDPEVQFNWYVDGVEVHNAKTKPREEQFNST

YRVVSVLTVLHQDWLNGKEYKCKVSNKGLPSSIEKTISKAKGQPREPQVYTLPPSQEEM

TKNQVSLTCLVKGFYPSDIAVEWESNGQPENNYKTTPPVLDSDGSFFLYSRLTVDKSRW

QEGNVFSCSVMHEALHNHYTQKSLSLSLGK

Human IgA1 constant region, Uniprot: P01876
(SEQ ID NO: 122)
ASPTSPKVFPLSLCSTQPDGNVVIACLVQGFFPQEPLSVTWSESGQGVTARNFPPSQDAS

GDLYTTSSQLTLPATQCLAGKSVTCHVKHYTNPSQDVTVPCPVPSTPPTPSPSTPPTPSPS

CCHPRLSLHRPALEDLLLGSEANLTCTLTGLRDASGVTFTWTPSSGKSAVQGPPERDLC

```
-continued
GCYSVSSVLPGCAEPWNHGKTFTCTAAYPESKTPLTATLSKSGNTFRPEVHLLPPPSEEL

ALNELVTLTCLARGFSPKDVLVRWLQGSQELPREKYLTWASRQEPSQGTTTFAVTSILR

VAAEDWKKGDTFSCMVGHEALPLAFTQKTIDRLAGKPTHVNVSVVMAEVDGTCY

Human IgA2 constant region, Uniprot: P01877
                                                    (SEQ ID NO: 123)
ASPTSPKVFPLSLDSTPQDGNVVVACLVQGFFPQEPLSVTWSESGQNVTARNFPPSQDAS

GDLYTTSSQLTLPATQCPDGKSVTCHVKHYTNPSQDVTVPCPVPPPPPCCHPRLSLHRPA

LEDLLLGSEANLTCTLTGLRDASGATFTWTPSSGKSAVQGPPERDLCGCYSVSSVLPGC

AQPWNHGETFTCTAAHPELKTPLTANITKSGNTFRPEVHLLPPPSEELALNELVTLTCLA

RGFSPKDVLVRWLQGSQELPREKYLTWASRQEPSQGTTTFAVTSILRVAAEDWKKGDT

FSCMVGHEALPLAFTQKTIDRMAGKPTHVNVSVVMAEVDGTCY

Human Ig kappa constant region, Uniprot: P01834
                                                    (SEQ ID NO: 124)
TVAAPSVFIFPPSDEQLKSGTASVVCLLNNFYPREAKVQWKVDNALQSGNSQESVTEQD

SKDSTYSLSSTLTLSKADYEKHKVYACEVTHQGLSSPVTKSFNRGEC
```

In some embodiments, the immunoglobulin-related compositions of the present technology comprise a heavy chain constant region that is at least 80%, at least 85%, at least 90%, at least 95%, at least 99%, or is 100% identical to SEQ ID NOS: 116-123. Additionally or alternatively, in some embodiments, the immunoglobulin-related compositions of the present technology comprise a light chain constant region that is at least 80%, at least 85%, at least 90%, at least 95%, at least 99%, or is 100% identical to SEQ ID NO: 124. In some embodiments, the immunoglobulin-related compositions of the present technology bind to the IgC2 domain of CD33. In some embodiments, the epitope is a conformational epitope.

In another aspect, the present disclosure provides an isolated immunoglobulin-related composition (e.g., an antibody or antigen binding fragment thereof) comprising a heavy chain (HC) amino acid sequence comprising SEQ ID NO: 16, SEQ ID NO: 20, SEQ ID NO: 22, SEQ ID NO: 136, SEQ ID NO: 139, SEQ ID NO: 141, or a variant thereof having one or more conservative amino acid substitutions.

Additionally or alternatively, in some embodiments, the immunoglobulin-related compositions of the present technology comprise a light chain (LC) amino acid sequence comprising SEQ ID NO: 14, SEQ ID NO: 18, SEQ ID NO: 24, SEQ ID NO: 26, SEQ ID NO: 27, SEQ ID NO: 28, SEQ ID NO: 29, SEQ ID NO: 134, SEQ ID NO: 138, SEQ ID NO: 140, or a variant thereof having one or more conservative amino acid substitutions.

In some embodiments, the immunoglobulin-related compositions of the present technology comprise a HC amino acid sequence and a LC amino acid sequence selected from the group consisting of: SEQ ID NO: 16 and SEQ ID NO: 14 (chHIM34×CD3 BsAb); SEQ ID NO: 20 and SEQ ID NO: 18 (BC249—hHIM34×CD3 BsAb); SEQ ID NO: 136 and SEQ ID NO: 134 (BC275—hHIM34×CD3 BsAb); SEQ ID NO: 22 and SEQ ID NO: 18 (BC267—hHIM34×CD3 BsAb); SEQ ID NO: 22 and SEQ ID NO: 24 (BC268—hHIM34×CD3 BsAb); SEQ ID NO: 20 and SEQ ID NO: 26 (VL3VH5×mC825); SEQ ID NO: 20 and SEQ ID NO: 27 (VL3VH5×hC825); SEQ ID NO: 22 and SEQ ID NO: 26 (VL3VH6×mC825); SEQ ID NO: 22 and SEQ ID NO: 27 (VL3VH6×hC825); SEQ ID NO: 22 and SEQ ID NO: 28 (VL4VH6×mC825); SEQ ID NO: 22 and SEQ ID NO: 29 (VL4VH6×hC825), SEQ ID NO: 139 and SEQ ID NO: 138 (mouse VL-mouseVH×mC825); and SEQ ID NO: 141 and SEQ ID NO: 140 (mouse VL-mouseVH×hC825), respectively.

In any of the above embodiments of the immunoglobulin-related compositions, the HC and LC immunoglobulin variable domain sequences form an antigen binding site that binds to the IgC2 domain of CD33. In some embodiments, the epitope is a conformational epitope.

In some embodiments, the HC and LC immunoglobulin variable domain sequences are components of the same polypeptide chain. In other embodiments, the HC and LC immunoglobulin variable domain sequences are components of different polypeptide chains. In certain embodiments, the antibody is a full-length antibody.

In some embodiments, the immunoglobulin-related compositions of the present technology bind specifically to at least one CD33 polypeptide. In some embodiments, the immunoglobulin-related compositions of the present technology bind at least one CD33 polypeptide with a dissociation constant ($K_D$) of about $10^{-3}$M, $10^{-4}$M, $10^{-5}$M, $10^{-6}$M, $10^{-7}$M, $10^{-8}$M, $10^{-9}$M, $10^{-10}$ M, $10^{-11}$ M, or $10^{-12}$M. In certain embodiments, the immunoglobulin-related compositions are monoclonal antibodies, chimeric antibodies, humanized antibodies, or bispecific antibodies. In some embodiments, the antibodies comprise a human antibody framework region.

In certain embodiments, the immunoglobulin-related composition includes one or more of the following characteristics: (a) a light chain immunoglobulin variable domain sequence that is at least 80%, at least 85%, at least 90%, at least 95%, or at least 99% identical to the light chain immunoglobulin variable domain sequence present in any one of SEQ ID NOs: 9, 10, 11, 12, or 13; and/or (b) a heavy chain immunoglobulin variable domain sequence that is at least 80%, at least 85%, at least 90%, at least 95%, or at least 99% identical to the heavy chain immunoglobulin variable domain sequence present in any one of SEQ ID NOs: 2, 3, 4, 5, 6, 7, or 133. In another aspect, one or more amino acid residues in the immunoglobulin-related compositions provided herein are substituted with another amino acid. The substitution may be a "conservative substitution" as defined herein.

In some embodiments, the immunoglobulin-related composition comprises (a) a LC sequence that is at least 80%, at least 85%, at least 90%, at least 95%, or at least 99% identical to the LC sequence present in any one of SEQ ID NOs: 14, 18, 24, 26, 27, 28, 29, 134, 138, or 140; and/or (b) a HC sequence that is at least 80%, at least 85%, at least 90%, at least 95%, or at least 99% identical to the HC sequence present in any one of SEQ ID NOs: 16, 20, 22, 136, 139, or 141.

In one aspect, the present disclosure provides an immunoglobulin-related composition comprising an amino acid sequence that is at least 80%, at least 85%, at least 90%, at least 95%, or at least 99% identical identical to an amino acid sequence selected from SEQ ID NOs. 30-113 or 142-153. In certain embodiments, an immunoglobulin-related composition of the present disclosure comprises an amino acid sequence selected from SEQ ID NOs. 30-113 or 142-153.

In one aspect, the present disclosure provides a bispecific antigen binding fragment comprising a first polypeptide chain, wherein: the first polypeptide chain comprises in the N-terminal to C-terminal direction: (i) a heavy chain variable domain of a first immunoglobulin that is capable of specifically binding to a first epitope; (ii) a flexible peptide linker comprising the amino acid sequence (GGGGS)$_6$ (SEQ ID NO: 161); (iii) a light chain variable domain of the first immunoglobulin; (iv) a flexible peptide linker comprising the amino acid sequence (GGGGS)$_4$ (SEQ ID NO: 162); (v) a heavy chain variable domain of a second immunoglobulin that is capable of specifically binding to a second epitope; (vi) a flexible peptide linker comprising the amino acid sequence (GGGGS)$_6$ (SEQ ID NO: 161); (vii) a light chain variable domain of the second immunoglobulin; (viii) a flexible peptide linker sequence comprising the amino acid sequence TPLGDTTHT (SEQ ID NO: 163); and (ix) a self-assembly disassembly (SADA) polypeptide, wherein the heavy chain variable domain of the first immunoglobulin is selected from the group consisting of: SEQ ID NO: 2, SEQ ID NO: 3, SEQ ID NO: 4, SEQ ID NO: 5, SEQ ID NO: 6, SEQ ID NO: 7, and SEQ ID NO: 133; and/or the light chain variable domain of the first immunoglobulin is selected from the group consisting of: SEQ ID NO: 9, SEQ ID NO: 10, SEQ ID NO: 11, SEQ ID NO: 12, and SEQ ID NO: 13.

In another aspect, the present disclosure provides a bispecific antigen binding fragment comprising a first polypeptide chain, wherein: the first polypeptide chain comprises in the N-terminal to C-terminal direction: (i) a light chain variable domain of a first immunoglobulin that is capable of specifically binding to a first epitope; (ii) a flexible peptide linker comprising the amino acid sequence (GGGGS)$_6$ (SEQ ID NO: 161); (iii) a heavy chain variable domain of the first immunoglobulin; (iv) a flexible peptide linker comprising the amino acid sequence (GGGGS)$_4$ (SEQ ID NO: 162); (v) a heavy chain variable domain of a second immunoglobulin that is capable of specifically binding to a second epitope; (vi) a flexible peptide linker comprising the amino acid sequence (GGGGS)$_6$ (SEQ ID NO: 161); (vii) a light chain variable domain of the second immunoglobulin; (viii) a flexible peptide linker sequence comprising the amino acid sequence TPLGDTTHT (SEQ ID NO: 163); and (ix) a self-assembly disassembly (SADA) polypeptide, wherein the heavy chain variable domain of the first immunoglobulin is selected from the group consisting of: SEQ ID NO: 2, SEQ ID NO: 3, SEQ ID NO: 4, SEQ ID NO: 5, SEQ ID NO: 6, SEQ ID NO: 7, and SEQ ID NO: 133; and/or the light chain variable domain of the first immunoglobulin is selected from the group consisting of: SEQ ID NO: 9, SEQ ID NO: 10, SEQ ID NO: 11, SEQ ID NO: 12, and SEQ ID NO: 13.

In certain embodiments of the bispecific antigen binding fragments disclosed herein, the SADA polypeptide comprises a tetramerization, pentamerization, or hexamerization domain. In some embodiments, the SADA polypeptide comprises a tetramerization domain of any one of p53, p63, p'73, hnRNPC, SNA-23, Stefin B, KCNQ4, and CBFA2T1. Additionally or alternatively, in some embodiments, the bispecific antigen binding fragment comprises an amino acid sequence selected from SEQ ID NOs. 30-113 or 142-153.

In one aspect, the present disclosure provides a bispecific antibody comprising a first polypeptide chain, a second polypeptide chain, a third polypeptide chain and a fourth polypeptide chain, wherein the first and second polypeptide chains are covalently bonded to one another, the second and third polypeptide chains are covalently bonded to one another, and the third and fourth polypeptide chain are covalently bonded to one another, and wherein: (a) each of the first polypeptide chain and the fourth polypeptide chain comprises in the N-terminal to C-terminal direction: (i) a light chain variable domain of a first immunoglobulin that is capable of specifically binding to a first epitope; (ii) a light chain constant domain of the first immunoglobulin; (iii) a flexible peptide linker comprising the amino acid sequence (GGGGS)$_3$ (SEQ ID NO: 164); and (iv) a light chain variable domain of a second immunoglobulin that is linked to a complementary heavy chain variable domain of the second immunoglobulin, or a heavy chain variable domain of a second immunoglobulin that is linked to a complementary light chain variable domain of the second immunoglobulin, wherein the light chain and heavy chain variable domains of the second immunoglobulin are capable of specifically binding to a second epitope, and are linked together via a flexible peptide linker comprising the amino acid sequence (GGGGS)$_6$ (SEQ ID NO: 161) to form a single-chain variable fragment; and (b) each of the second polypeptide chain and the third polypeptide chain comprises in the N-terminal to C-terminal direction: (i) a heavy chain variable domain of the first immunoglobulin that is capable of specifically binding to the first epitope; and (ii) a heavy chain constant domain of the first immunoglobulin; and wherein the heavy chain variable domain of the first immunoglobulin is selected from the group consisting of: SEQ ID NO: 2, SEQ ID NO: 3, SEQ ID NO: 4, SEQ ID NO: 5, SEQ ID NO: 6, SEQ ID NO: 7, and SEQ ID NO: 133; and/or the light chain variable domain of the first immunoglobulin is selected from the group consisting of: SEQ ID NO: 9, SEQ ID NO: 10, SEQ ID NO: 11, SEQ ID NO: 12, and SEQ ID NO: 13. In certain embodiments, the second immunoglobulin binds to CD3, CD4, CD8, CD20, CD19, CD21, CD23, CD46, CD80, HLA-DR, CD74, CD22, CD14, CD15, CD16, CD123, TCR gamma/delta, NKp46, KIR, or a small molecule DOTA hapten.

In certain embodiments, the immunoglobulin-related compositions contain an IgG1 constant region comprising one or more amino acid substitutions selected from the group consisting of N297A and K322A. Additionally or alternatively, in some embodiments, the immunoglobulin-related compositions contain an IgG4 constant region comprising a S228P mutation.

In some aspects, the anti-CD33 immunoglobulin-related compositions described herein contain structural modifications to facilitate rapid binding and cell uptake and/or slow release. In some aspects, the anti-CD33 immunoglobulin-related composition of the present technology (e.g., an antibody) may contain a deletion in the CH$_2$ constant heavy chain region to facilitate rapid binding and cell uptake and/or slow release. In some aspects, a Fab fragment is used to facilitate rapid binding and cell uptake and/or slow release. In some aspects, a F(ab)'2 fragment is used to facilitate rapid binding and cell uptake and/or slow release.

In one aspect, the present technology provides a nucleic acid sequence encoding any of the immunoglobulin-related compositions described herein. Also disclosed herein are recombinant nucleic acid sequences encoding any of the antibodies described herein. In some embodiments, the nucleic acid sequence is selected from the group consisting of SEQ ID NOs: 15, 17, 19, 21, 23, 25, 135 and 137.

In another aspect, the present technology provides a host cell expressing any nucleic acid sequence encoding any of the immunoglobulin-related compositions described herein.

The immunoglobulin-related compositions of the present technology (e.g., an anti-CD33 antibody) can be monospecific, bispecific, trispecific or of greater multispecificity. Multispecific antibodies can be specific for different epitopes of one or more CD33 polypeptides or can be specific for both the CD33 polypeptide(s) as well as for heterologous compositions, such as a heterologous polypeptide or solid support material. See, e.g., WO 93/17715; WO 92/08802; WO 91/00360; WO 92/05793; Tuft et al., *J. Immunol.* 147: 60-69 (1991); U.S. Pat. Nos. 5,573,920, 4,474,893, 5,601,819, 4,714,681, 4,925,648; 6,106,835; Kostelny et al., *J. Immunol.* 148: 1547-1553 (1992). In some embodiments, the immunoglobulin-related compositions are chimeric. In certain embodiments, the immunoglobulin-related compositions are humanized.

The immunoglobulin-related compositions of the present technology can further be recombinantly fused to a heterologous polypeptide at the N- or C-terminus or chemically conjugated (including covalently and non-covalently conjugations) to polypeptides or other compositions. For example, the immunoglobulin-related compositions of the present technology can be recombinantly fused or conjugated to molecules useful as labels in detection assays and effector molecules such as heterologous polypeptides, drugs, or toxins. See, e.g., WO 92/08495; WO 91/14438; WO 89/12624; U.S. Pat. No. 5,314,995; and EP 0 396 387.

In any of the above embodiments of the immunoglobulin-related compositions of the present technology, the antibody or antigen binding fragment may be optionally conjugated to an agent selected from the group consisting of isotopes, dyes, chromagens, contrast agents, drugs, toxins, cytokines, enzymes, enzyme inhibitors, hormones, hormone antagonists, growth factors, radionuclides, metals, liposomes, nanoparticles, RNA, DNA or any combination thereof. For a chemical bond or physical bond, a functional group on the immunoglobulin-related composition typically associates with a functional group on the agent. Alternatively, a functional group on the agent associates with a functional group on the immunoglobulin-related composition.

The functional groups on the agent and immunoglobulin-related composition can associate directly. For example, a functional group (e.g., a sulfhydryl group) on an agent can associate with a functional group (e.g., sulfhydryl group) on an immunoglobulin-related composition to form a disulfide. Alternatively, the functional groups can associate through a cross-linking agent (i.e., linker). Some examples of cross-linking agents are described below. The cross-linker can be attached to either the agent or the immunoglobulin-related composition. The number of agents or immunoglobulin-related compositions in a conjugate is also limited by the number of functional groups present on the other. For example, the maximum number of agents associated with a conjugate depends on the number of functional groups present on the immunoglobulin-related composition. Alternatively, the maximum number of immunoglobulin-related compositions associated with an agent depends on the number of functional groups present on the agent.

In yet another embodiment, the conjugate comprises one immunoglobulin-related composition associated to one agent. In one embodiment, a conjugate comprises at least one agent chemically bonded (e.g., conjugated) to at least one immunoglobulin-related composition. The agent can be chemically bonded to an immunoglobulin-related composition by any method known to those in the art. For example, a functional group on the agent may be directly attached to a functional group on the immunoglobulin-related composition. Some examples of suitable functional groups include, for example, amino, carboxyl, sulfhydryl, maleimide, isocyanate, isothiocyanate and hydroxyl.

The agent may also be chemically bonded to the immunoglobulin-related composition by means of cross-linking agents, such as dialdehydes, carbodiimides, dimaleimides, and the like. Cross-linking agents can, for example, be obtained from Pierce Biotechnology, Inc., Rockford, Ill. The Pierce Biotechnology, Inc. web-site can provide assistance. Additional cross-linking agents include the platinum cross-linking agents described in U.S. Pat. Nos. 5,580,990; 5,985, 566; and 6,133,038 of Kreatech Biotechnology, B.V., Amsterdam, The Netherlands.

Alternatively, the functional group on the agent and immunoglobulin-related composition can be the same. Homobifunctional cross-linkers are typically used to cross-link identical functional groups. Examples of homobifunctional cross-linkers include EGS (i.e., ethylene glycol bis [succinimidylsuccinate]), DSS (i.e., disuccinimidyl suberate), DMA (i.e., dimethyl adipimidate.2HCl), DTSSP (i.e., 3,3'-dithiobis[sulfosuccinimidylpropionate])), DPDPB (i.e., 1,4-di-[3'-(2'-pyridyldithio)-propionamido]butane), and BMH (i.e., bis-maleimidohexane). Such homobifunctional cross-linkers are also available from Pierce Biotechnology, Inc.

In other instances, it may be beneficial to cleave the agent from the immunoglobulin-related composition. The web-site of Pierce Biotechnology, Inc. described above can also provide assistance to one skilled in the art in choosing suitable cross-linkers which can be cleaved by, for example, enzymes in the cell. Thus the agent can be separated from the immunoglobulin-related composition. Examples of cleavable linkers include SMPT (i.e., 4-succinimidyloxycarbonyl-methyl-a-[2-pyridyldithio]toluene), Sulfo-LC-SPDP (i.e., sulfosuccinimidyl 6-(3-[2-pyridyldithio]-propionamido)hexanoate), LC-SPDP (i.e., succinimidyl 6-(3-[2-pyridyldithio]-propionamido)hexanoate), Sulfo-LC-SPDP (i.e., sulfosuccinimidyl 6-(3-[2-pyridyldithio]-propionamido)hexanoate), SPDP (i.e., N-succinimidyl 3-[2-pyridyldithio]-propionamidohexanoate), and AEDP (i.e., 3-[(2-aminoethyl)dithio]propionic acid HCl).

In another embodiment, a conjugate comprises at least one agent physically bonded with at least one immunoglobulin-related composition. Any method known to those in the art can be employed to physically bond the agents with the immunoglobulin-related compositions. For example, the immunoglobulin-related compositions and agents can be mixed together by any method known to those in the art. The order of mixing is not important. For instance, agents can be physically mixed with immunoglobulin-related compositions by any method known to those in the art. For example, the immunoglobulin-related compositions and agents can be placed in a container and agitated, by for example, shaking the container, to mix the immunoglobulin-related compositions and agents.

The immunoglobulin-related compositions can be modified by any method known to those in the art. For instance, the immunoglobulin-related composition may be modified by means of cross-linking agents or functional groups, as described above.

A. Methods of Preparing Anti-CD33 Antibodies of the Present Technology

General Overview. Initially, a target polypeptide is chosen to which an antibody of the present technology can be raised. For example, an antibody may be raised against the full-length CD33 protein, a CD33 protein lacking the outer IgV domain, or to a portion of the extracellular domain of the CD33 protein (e.g., the IgC2 domain). Techniques for generating antibodies directed to such target polypeptides are well known to those skilled in the art. Examples of such techniques include, for example, but are not limited to, those involving display libraries, xeno or human mice, hybridomas, and the like. Target polypeptides within the scope of the present technology include any polypeptide derived from CD33 protein containing the extracellular domain which is capable of eliciting an immune response (e.g., the IgC2 domain).

It should be understood that recombinantly engineered antibodies and antibody fragments, e.g., antibody-related polypeptides, which are directed to CD33 protein and fragments thereof are suitable for use in accordance with the present disclosure.

Anti-CD33 antibodies that can be subjected to the techniques set forth herein include monoclonal and polyclonal antibodies, and antibody fragments such as Fab, Fab', F(ab')$_2$, Fd, scFv, diabodies, antibody light chains, antibody heavy chains and/or antibody fragments. Methods useful for the high yield production of antibody $F_v$-containing polypeptides, e.g., Fab' and F(ab')$_2$ antibody fragments have been described. See U.S. Pat. No. 5,648,237.

Generally, an antibody is obtained from an originating species. More particularly, the nucleic acid or amino acid sequence of the variable portion of the light chain, heavy chain or both, of an originating species antibody having specificity for a target polypeptide antigen is obtained. An originating species is any species which was useful to generate the antibody of the present technology or library of antibodies, e.g., rat, mouse, rabbit, chicken, monkey, human, and the like.

Phage or phagemid display technologies are useful techniques to derive the antibodies of the present technology. Techniques for generating and cloning monoclonal antibodies are well known to those skilled in the art. Expression of sequences encoding antibodies of the present technology, can be carried out in *E. coli*.

Due to the degeneracy of nucleic acid coding sequences, other sequences which encode substantially the same amino acid sequences as those of the naturally occurring proteins may be used in the practice of the present technology These include, but are not limited to, nucleic acid sequences including all or portions of the nucleic acid sequences encoding the above polypeptides, which are altered by the substitution of different codons that encode a functionally equivalent amino acid residue within the sequence, thus producing a silent change. It is appreciated that the nucleotide sequence of an immunoglobulin according to the present technology tolerates sequence homology variations of up to 25% as calculated by standard methods ("Current Methods in Sequence Comparison and Analysis," *Macromolecule Sequencing and Synthesis, Selected Methods and Applications*, pp. 127-149, 1998, Alan R. Liss, Inc.) so long as such a variant forms an operative antibody which recognizes CD33 proteins. For example, one or more amino acid residues within a polypeptide sequence can be substituted by another amino acid of a similar polarity which acts as a functional equivalent, resulting in a silent alteration. Substitutes for an amino acid within the sequence may be selected from other members of the class to which the amino acid belongs. For example, the nonpolar (hydrophobic) amino acids include alanine, leucine, isoleucine, valine, proline, phenylalanine, tryptophan and methionine. The polar neutral amino acids include glycine, serine, threonine, cysteine, tyrosine, asparagine, and glutamine. The positively charged (basic) amino acids include arginine, lysine and histidine. The negatively charged (acidic) amino acids include aspartic acid and glutamic acid. Also included within the scope of the present technology are proteins or fragments or derivatives thereof which are differentially modified during or after translation, e.g., by glycosylation, proteolytic cleavage, linkage to an antibody molecule or other cellular ligands, etc. Additionally, an immunoglobulin encoding nucleic acid sequence can be mutated in vitro or in vivo to create and/or destroy translation, initiation, and/or termination sequences or to create variations in coding regions and/or form new restriction endonuclease sites or destroy pre-existing ones, to facilitate further in vitro modification. Any technique for mutagenesis known in the art can be used, including but not limited to in vitro site directed mutagenesis, *J. Biol. Chem.* 253:6551, use of Tab linkers (Pharmacia), and the like.

Preparation of Polyclonal Antisera and Immunogens. Methods of generating antibodies or antibody fragments of the present technology typically include immunizing a subject (generally a non-human subject such as a mouse or rabbit) with a purified CD33 protein or fragment thereof or with a cell expressing the CD33 protein or fragment thereof. An appropriate immunogenic preparation can contain, e.g., a recombinantly-expressed CD33 protein or a chemically-synthesized CD33 peptide. The extracellular domain of the CD33 protein, or a portion or fragment thereof (e.g., the IgC2 domain), can be used as an immunogen to generate an anti-CD33 antibody that binds to the CD33 protein, or a portion or fragment thereof using standard techniques for polyclonal and monoclonal antibody preparation.

The full-length CD33 protein or fragments thereof, are useful as fragments as immunogens. In some embodiments, a CD33 fragment comprises the IgC2 domain of CD33 such that an antibody raised against the peptide forms a specific immune complex with CD33 protein, including the short isoform of CD33 (a CD33 splice variant lacking the IgV domain).

The IgC2 domain of CD33 is 84 amino acids in length. In some embodiments, the antigenic CD33 peptide comprises at least 5, 8, 10, 15, 20, 30, 40, 50, 60, 70, or 80 amino acid residues. Longer antigenic peptides are sometimes desirable over shorter antigenic peptides, depending on use and according to methods well known to those skilled in the art. Multimers of a given epitope are sometimes more effective than a monomer.

If needed, the immunogenicity of the CD33 protein (or fragment thereof) can be increased by fusion or conjugation to a hapten such as keyhole limpet hemocyanin (KLH) or ovalbumin (OVA). Many such haptens are known in the art. One can also combine the CD33 protein with a conventional adjuvant such as Freund's complete or incomplete adjuvant to increase the subject's immune reaction to the polypeptide.

Various adjuvants used to increase the immunological response include, but are not limited to, Freund's (complete and incomplete), mineral gels (e.g., aluminum hydroxide), surface active substances (e.g., lysolecithin, pluronic polyols, polyanions, peptides, oil emulsions, dinitrophenol, etc.), human adjuvants such as Bacille Calmette-Guerin and *Corynebacterium parvum*, or similar immunostimulatory compounds. These techniques are standard in the art.

In describing the present technology, immune responses may be described as either "primary" or "secondary" immune responses. A primary immune response, which is also described as a "protective" immune response, refers to an immune response produced in an individual as a result of some initial exposure (e.g., the initial "immunization") to a particular antigen, e.g., CD33 protein. In some embodiments, the immunization can occur as a result of vaccinating the individual with a vaccine containing the antigen. For example, the vaccine can be a CD33 vaccine comprising one or more CD33 protein-derived antigens. A primary immune response can become weakened or attenuated over time and can even disappear or at least become so attenuated that it cannot be detected. Accordingly, the present technology also relates to a "secondary" immune response, which is also described here as a "memory immune response." The term secondary immune response refers to an immune response elicited in an individual after a primary immune response has already been produced.

Thus, a secondary immune response can be elicited, e.g., to enhance an existing immune response that has become weakened or attenuated, or to recreate a previous immune response that has either disappeared or can no longer be detected. The secondary or memory immune response can be either a humoral (antibody) response or a cellular response. A secondary or memory humoral response occurs upon stimulation of memory B cells that were generated at the first presentation of the antigen. Delayed type hypersensitivity (DTH) reactions are a type of cellular secondary or memory immune response that are mediated by CD4$^+$ T cells. A first exposure to an antigen primes the immune system and additional exposure(s) results in a DTH.

Following appropriate immunization, the anti-CD33 antibody can be prepared from the subject's serum. If desired, the antibody molecules directed against the CD33 protein can be isolated from the mammal (e.g., from the blood) and further purified by well-known techniques, such as polypeptide A chromatography to obtain the IgG fraction.

Monoclonal Antibody. In one embodiment of the present technology, the antibody is an anti-CD33 monoclonal antibody. For example, in some embodiments, the anti-CD33 monoclonal antibody may be a human or a mouse anti-CD33 monoclonal antibody. For preparation of monoclonal antibodies directed towards the CD33 protein, or derivatives, fragments, analogs or homologs thereof, any technique that provides for the production of antibody molecules by continuous cell line culture can be utilized. Such techniques include, but are not limited to, the hybridoma technique (See, e.g., Kohler & Milstein, 1975. *Nature* 256: 495-497); the trioma technique; the human B-cell hybridoma technique (See, e.g., Kozbor, et al., 1983. *Immunol. Today* 4: 72) and the EBV hybridoma technique to produce human monoclonal antibodies (See, e.g., Cole, et al., 1985. In: MONOCLONAL ANTIBODIES AND CANCER THERAPY, Alan R. Liss, Inc., pp. 77-96). Human monoclonal antibodies can be utilized in the practice of the present technology and can be produced by using human hybridomas (See, e.g., Cote, et al., 1983. *Proc. Natl. Acad. Sci.* USA 80: 2026-2030) or by transforming human B-cells with Epstein Barr Virus in vitro (See, e.g., Cole, et al., 1985. In: MONOCLONAL ANTIBODIES AND CANCER THERAPY, Alan R. Liss, Inc., pp. 77-96). For example, a population of nucleic acids that encode regions of antibodies can be isolated. PCR utilizing primers derived from sequences encoding conserved regions of antibodies is used to amplify sequences encoding portions of antibodies from the population and then DNAs encoding antibodies or fragments thereof, such as variable domains, are reconstructed from the amplified sequences. Such amplified sequences also can be fused to DNAs encoding other proteins—e.g., a bacteriophage coat, or a bacterial cell surface protein—for expression and display of the fusion polypeptides on phage or bacteria. Amplified sequences can then be expressed and further selected or isolated based, e.g., on the affinity of the expressed antibody or fragment thereof for an antigen or epitope present on the CD33 protein. Alternatively, hybridomas expressing anti-CD33 monoclonal antibodies can be prepared by immunizing a subject and then isolating hybridomas from the subject's spleen using routine methods. See, e.g., Milstein et al., (Galfre and Milstein, *Methods Enzymol* (1981) 73: 3-46). Screening the hybridomas using standard methods will produce monoclonal antibodies of varying specificity (i.e., for different epitopes) and affinity. A selected monoclonal antibody with the desired properties, e.g., CD33 binding, can be used as expressed by the hybridoma, it can be bound to a molecule such as polyethylene glycol (PEG) to alter its properties, or a cDNA encoding it can be isolated, sequenced and manipulated in various ways. Synthetic dendromeric trees can be added to reactive amino acid side chains, e.g., lysine, to enhance the immunogenic properties of CD33 protein. Also, CPG-dinucleotide techniques can be used to enhance the immunogenic properties of the CD33 protein. Other manipulations include substituting or deleting particular amino acyl residues that contribute to instability of the antibody during storage or after administration to a subject, and affinity maturation techniques to improve affinity of the antibody of the CD33 protein.

Hybridoma Technique. In some embodiments, the antibody of the present technology is an anti-CD33 monoclonal antibody produced by a hybridoma which includes a B cell obtained from a transgenic non-human animal, e.g., a transgenic mouse, having a genome comprising a human heavy chain transgene and a light chain transgene fused to an immortalized cell. Hybridoma techniques include those known in the art and taught in Harlow et al., *Antibodies: A Laboratory Manual* Cold Spring Harbor Laboratory, Cold Spring Harbor, N.Y., 349 (1988); Hammerling et al., *Monoclonal Antibodies And T-Cell Hybridomas*, 563-681 (1981). Other methods for producing hybridomas and monoclonal antibodies are well known to those of skill in the art.

Phage Display Technique. As noted above, the antibodies of the present technology can be produced through the application of recombinant DNA and phage display technology. For example, anti-CD33 antibodies, can be prepared using various phage display methods known in the art. In phage display methods, functional antibody domains are displayed on the surface of a phage particle which carries polynucleotide sequences encoding them. Phages with a desired binding property are selected from a repertoire or combinatorial antibody library (e.g., human or murine) by selecting directly with an antigen, typically an antigen bound or captured to a solid surface or bead. Phages used in these methods are typically filamentous phage including fd and M13 with Fab, Fv or disulfide stabilized Fv antibody domains that are recombinantly fused to either the phage gene III or gene VIII protein. In addition, methods can be adapted for the construction of Fab expression libraries (See, e.g., Huse, et al., *Science* 246: 1275-1281, 1989) to allow rapid and effective identification of monoclonal Fab fragments with the desired specificity for a CD33 polypeptide, e.g., a polypeptide or derivatives, fragments, analogs or homologs thereof. Other examples of phage display methods that can be used to make the antibodies of the present technology include those disclosed in Huston et al., *Proc. Natl. Acad. Sci U.S.A.*, 85: 5879-5883, 1988; Chaudhary et al., *Proc. Natl. Acad. Sci U.S.A.*, 87: 1066-1070, 1990; Brinkman et al., *J. Immunol. Methods* 182: 41-50, 1995; Ames et al., *J. Immunol. Methods* 184: 177-186, 1995; Kettleborough et al., *Eur. J. Immunol.* 24: 952-958, 1994; Persic et al., *Gene* 187: 9-18, 1997; Burton et al., *Advances in Immunology* 57: 191-280, 1994; PCT/GB91/01134; WO 90/02809; WO 91/10737; WO 92/01047; WO 92/18619; WO 93/11236; WO 95/15982; WO 95/20401; WO 96/06213; WO 92/01047 (Medical Research Council et al.); WO 97/08320 (Morphosys); WO 92/01047 (CAT/MRC); WO 91/17271 (Affymax); and U.S. Pat. Nos. 5,698,426, 5,223,409, 5,403,484, 5,580,717, 5,427,908, 5,750,753, 5,821,047, 5,571,698, 5,427,908, 5,516,637, 5,780,225, 5,658,727 and 5,733,743. Methods useful for displaying polypeptides on the surface of bacteriophage particles by attaching the polypeptides via disulfide bonds have been described by Lohning, U.S. Pat. No. 6,753,136. As described in the above references, after phage selection, the antibody coding regions from the phage can be isolated and used to generate whole antibodies, including human antibodies, or any other desired antigen binding fragment, and expressed in any desired host including mammalian cells, insect cells, plant cells, yeast, and bacteria. For example, techniques to recombinantly produce Fab, Fab' and F(ab')$_2$ fragments can also be employed using methods known in the art such as those disclosed in WO 92/22324; Mullinax et al., *BioTechniques* 12: 864-869, 1992; and Sawai et al., *AJRI* 34: 26-34, 1995; and Better et al., *Science* 240: 1041-1043, 1988.

Generally, hybrid antibodies or hybrid antibody fragments that are cloned into a display vector can be selected against the appropriate antigen in order to identify variants that maintain good binding activity, because the antibody or antibody fragment will be present on the surface of the phage or phagemid particle. See, e.g., Barbas III et al., *Phage Display, A Laboratory Manual* (Cold Spring Harbor Laboratory Press, Cold Spring Harbor, N.Y., 2001). However, other vector formats could be used for this process, such as cloning the antibody fragment library into a lytic phage vector (modified T7 or Lambda Zap systems) for selection and/or screening.

Expression of Recombinant Anti-CD33 Antibodies. As noted above, the antibodies of the present technology can be produced through the application of recombinant DNA technology. Recombinant polynucleotide constructs encoding an anti-CD33 antibody of the present technology typically include an expression control sequence operably-linked to the coding sequences of anti-CD33 antibody chains, including naturally-associated or heterologous promoter regions. As such, another aspect of the technology includes vectors containing one or more nucleic acid sequences encoding an anti-CD33 antibody of the present technology. For recombinant expression of one or more of the polypeptides of the present technology, the nucleic acid containing all or a portion of the nucleotide sequence encoding the anti-CD33 antibody is inserted into an appropriate cloning vector, or an expression vector (i.e., a vector that contains the necessary elements for the transcription and translation of the inserted polypeptide coding sequence) by recombinant DNA techniques well known in the art and as detailed below. Methods for producing diverse populations of vectors have been described by Lerner et al., U.S. Pat. Nos. 6,291,160 and 6,680,192.

In general, expression vectors useful in recombinant DNA techniques are often in the form of plasmids. In the present disclosure, "plasmid" and "vector" can be used interchangeably as the plasmid is the most commonly used form of vector. However, the present technology is intended to include such other forms of expression vectors that are not technically plasmids, such as viral vectors (e.g., replication defective retroviruses, adenoviruses and adeno-associated viruses), which serve equivalent functions. Such viral vectors permit infection of a subject and expression of a construct in that subject. In some embodiments, the expression control sequences are eukaryotic promoter systems in vectors capable of transforming or transfecting eukaryotic host cells. Once the vector has been incorporated into the appropriate host, the host is maintained under conditions suitable for high level expression of the nucleotide sequences encoding the anti-CD33 antibody, and the collection and purification of the anti-CD33 antibody, e.g., cross-reacting anti-CD33 antibodies. See generally, U.S. 2002/0199213. These expression vectors are typically replicable in the host organisms either as episomes or as an integral part of the host chromosomal DNA. Commonly, expression vectors contain selection markers, e.g., ampicillin-resistance or hygromycin-resistance, to permit detection of those cells transformed with the desired DNA sequences. Vectors can also encode signal peptide, e.g., pectate lyase, useful to direct the secretion of extracellular antibody fragments. See U.S. Pat. No. 5,576,195.

The recombinant expression vectors of the present technology comprise a nucleic acid encoding a protein with CD33 binding properties in a form suitable for expression of the nucleic acid in a host cell, which means that the recombinant expression vectors include one or more regulatory sequences, selected on the basis of the host cells to be used for expression that is operably-linked to the nucleic acid sequence to be expressed. Within a recombinant expression vector, "operably-linked" is intended to mean that the nucleotide sequence of interest is linked to the regulatory sequence(s) in a manner that allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, e.g., in Goeddel, GENE EXPRESSION TECHNOLOGY: METHODS IN ENZYMOLOGY 185, Academic Press, San Diego, Calif. (1990). Regulatory sequences include those that direct constitutive expression of a nucleotide sequence in many types of host cell and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of polypeptide desired, etc. Typical regulatory sequences useful as promoters of recombinant polypeptide expression (e.g., anti-CD33 antibody), include, e.g., but are not limited to, promoters of 3-phosphoglycerate kinase and other glycolytic enzymes. Inducible yeast promoters include, among others, promoters from alcohol dehydrogenase, isocytochrome C, and enzymes responsible for maltose and galactose utilization. In one embodiment, a polynucleotide encoding an anti-CD33 antibody of the present technology is operably-linked to an ara B promoter and expressible in a host cell. See U.S. Pat. No. 5,028,530. The expression vectors of the present technology can be introduced into host cells to thereby produce polypeptides or peptides, including fusion polypeptides, encoded by nucleic acids as described herein (e.g., anti-CD33 antibody, etc.).

Another aspect of the present technology pertains to anti-CD33 antibody-expressing host cells, which contain a nucleic acid encoding one or more anti-CD33 antibodies. The recombinant expression vectors of the present technology can be designed for expression of an anti-CD33 antibody in prokaryotic or eukaryotic cells. For example, an anti-CD33 antibody can be expressed in bacterial cells such as *Escherichia coli*, insect cells (using baculovirus expression vectors), fungal cells, e.g., yeast, yeast cells or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, e.g., using T7 promoter regulatory sequences and T7 polymerase. Methods useful for the preparation and screening of polypeptides having a predetermined property, e.g., anti-CD33 antibody, via expression of stochastically generated polynucleotide sequences has been previously described. See U.S. Pat. Nos. 5,763,192; 5,723,323; 5,814,476; 5,817,483; 5,824,514; 5,976,862; 6,492,107; 6,569,641.

Expression of polypeptides in prokaryotes is most often carried out in *E. coli* with vectors containing constitutive or inducible promoters directing the expression of either fusion or non-fusion polypeptides. Fusion vectors add a number of amino acids to a polypeptide encoded therein, usually to the amino terminus of the recombinant polypeptide. Such fusion vectors typically serve three purposes: (i) to increase expression of recombinant polypeptide; (ii) to increase the solubility of the recombinant polypeptide; and (iii) to aid in the purification of the recombinant polypeptide by acting as a ligand in affinity purification. Often, in fusion expression vectors, a proteolytic cleavage site is introduced at the junction of the fusion moiety and the recombinant polypeptide to enable separation of the recombinant polypeptide from the fusion moiety subsequent to purification of the fusion polypeptide. Such enzymes, and their cognate recognition sequences, include Factor Xa, thrombin and enterokinase. Typical fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) that fuse glutathione S-transferase (GST), maltose E binding polypeptide, or polypeptide A, respectively, to the target recombinant polypeptide.

Examples of suitable inducible non-fusion *E. coli* expression vectors include pTrc (Amrann et al., (1988) *Gene* 69: 301-315) and pET 11d (Studier et al., GENE EXPRESSION TECHNOLOGY: METHODS IN ENZYMOLOGY 185, Academic Press, San Diego, Calif. (1990) 60-89). Methods for targeted assembly of distinct active peptide or protein domains to yield multifunctional polypeptides via polypeptide fusion has been described by Pack et al., U.S. Pat. Nos. 6,294,353; 6,692,935. One strategy to maximize recombinant polypeptide expression, e.g., an anti-CD33 antibody, in *E. coli* is to express the polypeptide in host bacteria with an impaired capacity to proteolytically cleave the recombinant polypeptide. See, e.g., Gottesman, GENE EXPRESSION TECHNOLOGY: METHODS IN ENZYMOLOGY 185, Academic Press, San Diego, Calif. (1990) 119-128. Another strategy is to alter the nucleic acid sequence of the nucleic acid to be inserted into an expression vector so that the individual codons for each amino acid are those preferentially utilized in the expression host, e.g., *E. coli* (See, e.g., Wada, et al., 1992. *Nucl. Acids Res.* 20: 2111-2118). Such alteration of nucleic acid sequences of the present technology can be carried out by standard DNA synthesis techniques.

In another embodiment, the anti-CD33 antibody expression vector is a yeast expression vector. Examples of vectors for expression in yeast *Saccharomyces cerevisiae* include pYepSec1 (Baldari, et al., 1987. *EMBO J.* 6: 229-234), pMFa (Kurjan and Herskowitz, *Cell* 30: 933-943, 1982), pJRY88 (Schultz et al., *Gene* 54: 113-123, 1987), pYES2 (Invitrogen Corporation, San Diego, Calif.), and picZ (Invitrogen Corp, San Diego, Calif.). Alternatively, an anti-CD33 antibody can be expressed in insect cells using baculovirus expression vectors. Baculovirus vectors available for expression of polypeptides, e.g., anti-CD33 antibody, in cultured insect cells (e.g., SF9 cells) include the pAc series (Smith, et al., *Mol. Cell. Biol.* 3: 2156-2165, 1983) and the pVL series (Lucklow and Summers, 1989. *Virology* 170: 31-39).

In yet another embodiment, a nucleic acid encoding an anti-CD33 antibody of the present technology is expressed in mammalian cells using a mammalian expression vector. Examples of mammalian expression vectors include, e.g., but are not limited to, pCDM8 (Seed, *Nature* 329: 840, 1987) and pMT2PC (Kaufman, et al., *EMBO J.* 6: 187-195, 1987). When used in mammalian cells, the expression vector's control functions are often provided by viral regulatory elements. For example, commonly used promoters are derived from polyoma, adenovirus 2, cytomegalovirus, and simian virus 40. For other suitable expression systems for both prokaryotic and eukaryotic cells that are useful for expression of the anti-CD33 antibody of the present technology, see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid in a particular cell type (e.g., tissue-specific regulatory elements). Tissue-specific regulatory elements are known in the art. Non-limiting examples of suitable tissue-specific promoters include the albumin promoter (liver-specific; Pinkert, et al., *Genes Dev.* 1: 268-277, 1987), lymphoid-specific promoters (Calame and Eaton, *Adv. Immunol.* 43: 235-275, 1988), promoters of T cell receptors (Winoto and Baltimore, *EMBO J.* 8: 729-733, 1989) and immunoglobulins (Banerji, et al., 1983. *Cell* 33: 729-740; Queen and Baltimore, *Cell* 33: 741-748, 1983), neuron-specific promoters (e.g., the neurofilament promoter; Byrne and Ruddle, *Proc. Natl. Acad. Sci. USA* 86: 5473-5477, 1989), pancreas-specific promoters (Edlund, et al., 1985. *Science* 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, *Science* 249: 374-379, 1990) and the α-fetoprotein promoter (Campes and Tilghman, *Genes Dev.* 3: 537-546, 1989).

Another aspect of the present methods pertains to host cells into which a recombinant expression vector of the present technology has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, an anti-CD33 antibody can be expressed in bacterial cells such as *E. coli*, insect cells, yeast or mammalian cells. Mammalian cells are a suitable host for expressing nucleotide segments encoding immunoglobulins or fragments thereof. See Winnacker, *From Genes To Clones*, (VCH Publishers, N Y, 1987). A number of suitable host cell lines capable of secreting intact heterologous proteins have been developed in the art, and include Chinese hamster ovary (CHO) cell lines, various COS cell lines, HeLa cells, L cells and myeloma cell lines. In some embodiments, the cells are non-human. Expression vectors for these cells can include expression control sequences, such as an origin of replication, a promoter, an enhancer, and necessary processing information sites, such as ribosome binding sites, RNA splice sites, polyadenylation sites, and transcriptional terminator sequences. Queen et al., Immunol. Rev. 89: 49, 1986. Illustrative expression control sequences are promoters derived from endogenous genes, cytomegalovirus, SV40, adenovirus, bovine papillomavirus, and the like. Co et al., *J Immunol.* 148: 1149, 1992. Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, electroporation, biolistics or viral-based transfection. Other methods used to transform mammalian cells include the use of polybrene, protoplast fusion, liposomes, electroporation, and microinjection (See generally, Sambrook et al., *Molecular Cloning*). Suitable methods for transforming or transfecting host cells can be found in Sambrook, et al. (MOLECULAR CLONING: A LABORATORY MANUAL. 2nd ed., Cold Spring Harbor Laboratory, Cold Spring Harbor Laboratory Press, Cold Spring Harbor, N.Y., 1989), and other laboratory manuals. The vectors containing the DNA segments of interest can be transferred into the host cell by well-known methods, depending on the type of cellular host.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Various selectable markers include those that confer resistance to drugs, such as G418, hygromycin and methotrexate. Nucleic acid encoding a selectable marker can be introduced into a host cell on the same vector as that encoding the anti-CD33 antibody or can be introduced on a separate vector. Cells stably transfected with the introduced nucleic acid can be identified by drug selection (e.g., cells that have incorporated the selectable marker gene will survive, while the other cells die).

A host cell that includes an anti-CD33 antibody of the present technology, such as a prokaryotic or eukaryotic host cell in culture, can be used to produce (i.e., express) recombinant anti-CD33 antibody. In one embodiment, the method comprises culturing the host cell (into which a recombinant expression vector encoding the anti-CD33 antibody has been introduced) in a suitable medium such that the anti-CD33 antibody is produced. In another embodiment, the method further comprises the step of isolating the anti-CD33 antibody from the medium or the host cell. Once expressed, collections of the anti-CD33 antibody, e.g., the anti-CD33 antibodies or the anti-CD33 antibody-related polypeptides are purified from culture media and host cells. The anti-CD33 antibody can be purified according to standard procedures of the art, including HPLC purification, column chromatography, gel electrophoresis and the like. In one embodiment, the anti-CD33 antibody is produced in a host organism by the method of Boss et al., U.S. Pat. No. 4,816,397. Usually, anti-CD33 antibody chains are expressed with signal sequences and are thus released to the culture media. However, if the anti-CD33 antibody chains are not naturally secreted by host cells, the anti-CD33 antibody chains can be released by treatment with mild detergent. Purification of recombinant polypeptides is well known in the art and includes ammonium sulfate precipitation, affinity chromatography purification technique, column chromatography, ion exchange purification technique, gel electrophoresis and the like (See generally Scopes, Protein Purification (Springer-Verlag, N.Y., 1982).

Polynucleotides encoding anti-CD33 antibodies, e.g., the anti-CD33 antibody coding sequences, can be incorporated in transgenes for introduction into the genome of a transgenic animal and subsequent expression in the milk of the transgenic animal. See, e.g., U.S. Pat. Nos. 5,741,957, 5,304,489, and 5,849,992. Suitable transgenes include coding sequences for light and/or heavy chains in operable linkage with a promoter and enhancer from a mammary gland specific gene, such as casein or β-lactoglobulin. For production of transgenic animals, transgenes can be microinjected into fertilized oocytes, or can be incorporated into the genome of embryonic stem cells, and the nuclei of such cells transferred into enucleated oocytes.

Single-Chain Antibodies. In one embodiment, the anti-CD33 antibody of the present technology is a single-chain anti-CD33 antibody. According to the present technology, techniques can be adapted for the production of single-chain antibodies specific to a CD33 protein (See, e.g., U.S. Pat. No. 4,946,778). Examples of techniques which can be used to produce single-chain Fvs and antibodies of the present technology include those described in U.S. Pat. Nos. 4,946,778 and 5,258,498; Huston et al., *Methods in Enzymology*, 203: 46-88, 1991; Shu, L. et al., *Proc. Natl. Acad. Sci. USA*, 90: 7995-7999, 1993; and Skerra et al., *Science* 240: 1038-1040, 1988.

Chimeric and Humanized Antibodies. In one embodiment, the anti-CD33 antibody of the present technology is a chimeric anti-CD33 antibody. In one embodiment, the anti-CD33 antibody of the present technology is a humanized anti-CD33 antibody. In one embodiment of the present technology, the donor and acceptor antibodies are monoclonal antibodies from different species. For example, the acceptor antibody is a human antibody (to minimize its antigenicity in a human), in which case the resulting CDR-grafted antibody is termed a "humanized" antibody.

Recombinant anti-CD33 antibodies, such as chimeric and humanized monoclonal antibodies, comprising both human and non-human portions, can be made using standard recombinant DNA techniques, and are within the scope of the present technology. For some uses, including in vivo use of the anti-CD33 antibody of the present technology in humans as well as use of these agents in in vitro detection assays, it is possible to use chimeric or humanized anti-CD33 antibodies. Such chimeric and humanized monoclonal antibodies can be produced by recombinant DNA techniques known in the art. Such useful methods include, e.g., but are not limited to, methods described in International Application No. PCT/US86/02269; U.S. Pat. No. 5,225,539; European Patent No. 184187; European Patent No. 171496; European Patent No. 173494; PCT International Publication No. WO 86/01533; U.S. Pat. Nos. 4,816,567; 5,225,539; European Patent No. 125023; Better, et al., 1988. *Science* 240: 1041-1043; Liu, et al., 1987. *Proc. Natl. Acad. Sci. USA* 84: 3439-3443; Liu, et al., 1987. *J. Immunol.* 139: 3521-3526; Sun, et al., 1987. *Proc. Natl. Acad. Sci. USA* 84: 214-218; Nishimura, et al., 1987. *Cancer Res.* 47: 999-1005; Wood, et al., 1985. *Nature* 314: 446-449; Shaw, et al., 1988. *J Natl. Cancer Inst.* 80: 1553-1559; Morrison (1985) *Science* 229: 1202-1207; Oi, et al. (1986) *BioTechniques* 4: 214; Jones, et al., 1986. *Nature* 321: 552-525; Verhoeyan, et al., 1988. *Science* 239: 1534; Morrison, *Science* 229: 1202, 1985; Oi et al., *BioTechniques* 4: 214, 1986; Gillies et al., *J. Immunol. Methods,* 125: 191-202, 1989; U.S. Pat. No. 5,807,715; and Beidler, et al., 1988. *J. Immunol.* 141: 4053-4060. For example, antibodies can be humanized using a variety of techniques including CDR-grafting (EP 0 239 400; WO 91/09967; U.S. Pat. Nos. 5,530,101; 5,585,089; 5,859,205; 6,248,516; EP460167), veneering or resurfacing (EP 0 592 106; EP 0 519 596; Padlan E. A., *Molecular Immunology,* 28: 489-498, 1991; Studnicka et al., *Protein Engineering* 7: 805-814, 1994; Roguska et al., *PNAS* 91: 969-973, 1994), and chain shuffling (U.S. Pat. No. 5,565,332). In one embodiment, a cDNA encoding a murine anti-CD33 monoclonal antibody is digested with a restriction enzyme selected specifically to remove the sequence encoding the Fc constant region, and the equivalent portion of a cDNA encoding a human Fc constant region is substituted (See Robinson et al., PCT/US86/02269; Akira et al., European Patent Application 184,187; Taniguchi, European Patent Application 171,496; Morrison et al., European Patent Application 173,494; Neuberger et al., WO 86/01533; Cabilly et al. U.S. Pat. No. 4,816,567; Cabilly et al., European Patent Application 125,023; Better et al. (1988) *Science* 240: 1041-1043; Liu et al. (1987) *Proc. Natl. Acad. Sci. USA* 84: 3439-3443; Liu et al. (1987)*J Immunol* 139: 3521-3526; Sun et al. (1987) *Proc. Natl. Acad. Sci. USA* 84: 214-218; Nishimura et al. (1987) *Cancer Res* 47: 999-1005; Wood et al. (1985) *Nature* 314: 446-449; and Shaw et al. (1988) *J. Natl. Cancer Inst.* 80: 1553-1559; U.S. Pat. Nos. 6,180,370; 6,300,064; 6,696,248; 6,706,484; 6,828,422.

In one embodiment, the present technology provides the construction of humanized anti-CD33 antibodies that are unlikely to induce a human anti-mouse antibody (hereinafter referred to as "HAMA") response, while still having an effective antibody effector function. As used herein, the terms "human" and "humanized", in relation to antibodies, relate to any antibody which is expected to elicit a therapeutically tolerable weak immunogenic response in a human subject. In one embodiment, the present technology provides for a humanized anti-CD33 antibodies, heavy and light chain immunoglobulins.

CDR Antibodies. In some embodiments, the anti-CD33 antibody of the present technology is an anti-CD33 CDR antibody. Generally the donor and acceptor antibodies used to generate the anti-CD33 CDR antibody are monoclonal antibodies from different species; typically the acceptor antibody is a human antibody (to minimize its antigenicity in a human), in which case the resulting CDR-grafted antibody is termed a "humanized" antibody. The graft may be of a single CDR (or even a portion of a single CDR) within a single $V_H$ or $V_L$ of the acceptor antibody, or can be of multiple CDRs (or portions thereof) within one or both of the $V_H$ and $V_L$. Frequently, all three CDRs in all variable domains of the acceptor antibody will be replaced with the corresponding donor CDRs, though one needs to replace only as many as necessary to permit adequate binding of the resulting CDR-grafted antibody to CD33 protein. Methods for generating CDR-grafted and humanized antibodies are taught by Queen et al. U.S. Pat. Nos. 5,585,089; 5,693,761; 5,693,762; and Winter U.S. Pat. No. 5,225,539; and EP 0682040. Methods useful to prepare $V_H$ and $V_L$ polypeptides are taught by Winter et al., U.S. Pat. Nos. 4,816,397; 6,291,158; 6,291,159; 6,291,161; 6,545,142; EP 0368684; EP0451216; and EP0120694.

After selecting suitable framework region candidates from the same family and/or the same family member, either or both the heavy and light chain variable regions are produced by grafting the CDRs from the originating species into the hybrid framework regions. Assembly of hybrid antibodies or hybrid antibody fragments having hybrid variable chain regions with regard to either of the above aspects can be accomplished using conventional methods known to those skilled in the art. For example, DNA sequences encoding the hybrid variable domains described herein (i.e., frameworks based on the target species and CDRs from the originating species) can be produced by oligonucleotide synthesis and/or PCR. The nucleic acid encoding CDR regions can also be isolated from the originating species antibodies using suitable restriction enzymes and ligated into the target species framework by ligating with suitable ligation enzymes. Alternatively, the framework regions of the variable chains of the originating species antibody can be changed by site-directed mutagenesis.

Since the hybrids are constructed from choices among multiple candidates corresponding to each framework region, there exist many combinations of sequences which are amenable to construction in accordance with the principles described herein. Accordingly, libraries of hybrids can be assembled having members with different combinations of individual framework regions. Such libraries can be electronic database collections of sequences or physical collections of hybrids.

This process typically does not alter the acceptor antibody's FRs flanking the grafted CDRs. However, one skilled in the art can sometimes improve antigen binding affinity of the resulting anti-CD33 CDR-grafted antibody by replacing certain residues of a given FR to make the FR more similar to the corresponding FR of the donor antibody. Suitable locations of the substitutions include amino acid residues adjacent to the CDR, or which are capable of interacting with a CDR (See, e.g., U.S. Pat. No. 5,585,089, especially columns 12-16). Or one skilled in the art can start with the donor FR and modify it to be more similar to the acceptor FR or a human consensus FR. Techniques for making these modifications are known in the art. Particularly if the resulting FR fits a human consensus FR for that position, or is at least 90% or more identical to such a consensus FR, doing so may not increase the antigenicity of the resulting modified anti-CD33 CDR-grafted antibody significantly compared to the same antibody with a fully human FR.

Bispecific Antibodies (BsAbs). A bispecific antibody is an antibody that can bind simultaneously to two targets that have a distinct structure, e.g., two different target antigens, two different epitopes on the same target antigen, or a hapten and a target antigen or epitope on a target antigen. BsAbs can be made, for example, by combining heavy chains and/or light chains that recognize different epitopes of the same or different antigen. In some embodiments, by molecular function, a bispecific binding agent binds one antigen (or epitope) on one of its two binding arms (one VH/VL pair) and binds a different antigen (or epitope) on its second arm (a different VH/VL pair). By this definition, a bispecific binding agent has two distinct antigen binding arms (in both specificity and CDR sequences), and is monovalent for each antigen to which it binds.

Bispecific antibodies (BsAb) and bispecific antibody fragments (BsFab) of the present technology have at least one arm that specifically binds to, for example, CD33 and at least one other arm that specifically binds to a second target antigen. In some embodiments, the second target antigen is an antigen or epitope of a B-cell, a T-cell, a myeloid cell, a plasma cell, or a mast-cell. Additionally or alternatively, in certain embodiments, the second target antigen is selected from the group consisting of CD3, CD4, CD8, CD20, CD19, CD21, CD23, CD46, CD80, HLA-DR, CD74, CD22, CD14, CD15, CD16, CD123, TCR gamma/delta, NKp46 and KIR. In certain embodiments, the BsAbs are capable of binding to tumor cells that express CD33 antigen on the cell surface. In some embodiments, the BsAbs have been engineered to facilitate killing of tumor cells by directing (or recruiting) cytotoxic T cells to a tumor site. Other exemplary BsAbs include those with a first antigen binding site specific for CD33 and a second antigen binding site specific for a small molecule hapten (e.g., DTP A, IMP288, DOTA, DOTA-Bn, DOTA-desferrioxamine, other DOTA-chelates described herein, Biotin, fluorescein, or those disclosed in Goodwin, D A. et al, 1994, *Cancer Res.* 54(22):5937-5946).

A variety of bispecific fusion proteins can be produced using molecular engineering. For example, BsAbs have been constructed that either utilize the full immunoglobulin framework (e.g., IgG), single chain variable fragment (scFv), or combinations thereof. In some embodiments, the bispecific fusion protein is divalent, comprising, for example, a scFv with a single binding site for one antigen and a Fab fragment with a single binding site for a second antigen. In some embodiments, the bispecific fusion protein is divalent, comprising, for example, an scFv with a single binding site for one antigen and another scFv fragment with a single binding site for a second antigen. In other embodiments, the bispecific fusion protein is tetravalent, comprising, for example, an immunoglobulin (e.g., IgG) with two binding sites for one antigen and two identical scFvs for a second antigen. BsAbs composed of two scFv units in tandem have been shown to be a clinically successful bispecific antibody format. In some embodiments, BsAbs comprise two single chain variable fragments (scFvs) in tandem have been designed such that an scFv that binds a tumor antigen (e.g., CD33) is linked with an scFv that engages T cells (e.g., by binding CD3). In this way, T cells are recruited to a tumor site such that they can mediate cytotoxic killing of the tumor cells. See e.g., Dreier et al., *J. Immunol.* 170:4397-4402 (2003); Bargou et al., *Science* 321:974-977 (2008)). In some embodiments, BsAbs of the present technology comprise two single chain variable fragments (scFvs) in tandem have been designed such that an scFv that binds a tumor antigen (e.g., CD33) is linked with an scFv that engages a small molecule DOTA hapten.

Recent methods for producing BsAbs include engineered recombinant monoclonal antibodies which have additional cysteine residues so that they crosslink more strongly than the more common immunoglobulin isotypes. See, e.g., FitzGerald et al., *Protein Eng.* 10(10):1221-1225 (1997).

Another approach is to engineer recombinant fusion proteins linking two or more different single-chain antibody or antibody fragment segments with the needed dual specificities. See, e.g., Coloma et al., *Nature Biotech.* 15:159-163 (1997). A variety of bispecific fusion proteins can be produced using molecular engineering.

Bispecific fusion proteins linking two or more different single-chain antibodies or antibody fragments are produced in a similar manner. Recombinant methods can be used to produce a variety of fusion proteins. In some certain embodiments, a BsAb according to the present technology comprises an immunoglobulin, which immunoglobulin comprises a heavy chain and a light chain, and an scFv. In some certain embodiments, the scFv is linked to the C-terminal end of the heavy chain of any CD33 immunoglobulin disclosed herein. In some certain embodiments, scFvs are linked to the C-terminal end of the light chain of any CD33 immunoglobulin disclosed herein. In various embodiments, scFvs are linked to heavy or light chains via a linker sequence. Appropriate linker sequences necessary for the in-frame connection of the heavy chain Fd to the scFv are introduced into the $V_L$ and $V_{kappa}$ domains through PCR reactions. The DNA fragment encoding the scFv is then ligated into a staging vector containing a DNA sequence encoding the CH1 domain. The resulting scFv-CH1 construct is excised and ligated into a vector containing a DNA sequence encoding the $V_H$ region of a CD33 antibody. The resulting vector can be used to transfect an appropriate host cell, such as a mammalian cell for the expression of the bispecific fusion protein.

In some embodiments, a linker is at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100 or more amino acids in length. In some embodiments, a linker is characterized in that it tends not to adopt a rigid three-dimensional structure, but rather provides flexibility to the polypeptide (e.g., first and/or second antigen binding sites). In some embodiments, a linker is employed in a BsAb described herein based on specific properties imparted to the BsAb such as, for example, an increase in stability. In some embodiments, a BsAb of the present technology comprises a $G_4S$ linker (SEQ ID NO: 165). In some certain embodiments, a BsAb of the present technology comprises a $(G_4S)_n$ linker (SEQ ID NO: 166), wherein n is 1, 2, 3, 4, 5, 6, 7, 8, 9, 10, 11, 12, 13, 14, 15 or more.

Self assembly disassembly (SADA) Conjugates. In some embodiments, the anti-CD33 antibodies of the present technology comprise one or more SADA domains. SADA domains can be designed and/or tailored to achieve environmentally-dependent multimerization with beneficial kinetic, thermodynamic, and/or pharmacologic properties. For example, it is recognized that SADA domains may be part of a conjugate that permit effective delivery of a payload to a target site of interest while minimizing the risk of off-target interactions. The anti-CD33 antibodies of the present technology may comprise a SADA domain linked to one or more binding domains. In some embodiments, such conjugates are characterized in that they multimerize to form a complex of a desired size under relevant conditions (e.g., in a solution in which the conjugate is present above a threshold concentration or pH and/or when present at a target site characterized by a relevant level or density of receptors for the payload), and disassemble to a smaller form under other conditions (e.g., absent the relevant environmental multimerization trigger).

A SADA conjugate may have improved characteristics compared to a conjugate without a SADA domain. In some embodiments, improved characteristics of a multimeric conjugate include: increased avidity/binding to a target, increased specificity for target cells or tissues, and/or extended initial serum half-life. In some embodiments, improved characteristics include that through dissociation to smaller states (e.g., dimeric or monomeric), a SADA conjugate exhibits reduced non-specific binding, decreased toxicity, and/or improved renal clearance. In some embodiments, a SADA conjugate comprises a SADA polypeptide having an amino acid sequence that shows at least 75% identity with that of a human homo-multimerizing polypeptide and is characterized by one or more multimerization dissociation constants ($K_D$).

In some embodiments, a SADA conjugate is constructed and arranged so that it adopts a first multimerization state and one or more higher-order multimerization states. In some embodiments, a first multimerization state is less than about ~70 kDa in size. In some embodiments, a first multimerization state is an unmultimerized state (e.g., a monomer or a dimer). In some embodiments, a first multimerization state is a monomer. In some embodiments, a first multimerization state is a dimer. In some embodiments, a first multimerization state is a multimerized state (e.g., a trimer or a tetramer). In some embodiments, a higher-order multimerization states is a homo-tetramer or higher-order homo-multimer greater than 150 kDa in size. In some embodiments, a higher-order homo-multimerized conjugate is stable in aqueous solution when the conjugate is present at a concentration above the SADA polypeptide $K_D$. In some embodiments, a SADA conjugate transitions from a higher-order multimerization state(s) to a first multimerization state under physiological conditions when the concentration of the conjugate is below the SADA polypeptide $K_D$.

In some embodiments, a SADA polypeptide is covalently linked to a binding domain via a linker. Any suitable linker known in the art can be used. In some embodiments, a SADA polypeptide is linked to a binding domain via a polypeptide linker. In some embodiments, a polypeptide linker is a Gly-Ser linker. In some embodiments, a polypeptide linker is or comprises a sequence of (GGGGS)n (SEQ ID NO: 167), where n represents the number of repeating GGGGS (SEQ ID NO: 165) units and is 1, 2, 3, 4, 5, 6, 7, 8, 9, 10, 11, 12, 13, 14, 15, 16, 17, 18, 19, 20, 25, 30 or more. In some embodiments, a binding domain is directly fused to a SADA polypeptide.

In some embodiments, a SADA domain is a human polypeptide or a fragment and/or derivative thereof. In some embodiments, a SADA domain is substantially non-immunogenic in a human. In some embodiments, a SADA polypeptide is stable as a multimer. In some embodiments, a SADA polypeptide lacks unpaired cysteine residues. In some embodiments, a SADA polypeptide does not have large exposed hydrophobic surfaces. In some embodiments, a SADA domain has or is predicted to have a structure comprising helical bundles that can associate in a parallel or anti-parallel orientation. In some embodiments, a SADA polypeptide is capable of reversible multimerization. In some embodiments, a SADA domain is a tetramerization domain, a heptamerization domain, a hexamerization domain or an octamerization domain. In certain embodiments, a SADA domain is a tetramerization domain. In some embodiments, a SADA domain is composed of a multimerization domains which are each composed of helical bundles that associate in a parallel or anti-parallel orientation. In some embodiments, a SADA domain is selected from the group of one of the following human proteins: p53, p63, p73, heterogeneous nuclear Ribonucleoprotein C (hnRNPC), N-terminal domain of Synaptosomal-associated protein 23 (SNAP-23), Stefin B (Cystatin B), Potassium voltage-gated channel subfamily KQT member 4 (KCNQ4), or Cyclin-D-related protein (CBFA2T1). Examples of suitable SADA domains are described in PCT/US2018/031235 which is hereby incorporated by reference in its entirety. Provided below are polypeptide sequences for exemplary SADA domains.

Human p53 tetramerization domain amino acid
sequence (321-359)
(SEQ ID NO: 125)
KPLDGEYFTLQIRGRERFEMFRELNEALELKDAQAGKEP Human p63 tetramerization domain amino acid
sequence (396-450)
(SEQ ID NO: 126)
RSPDDELLYLPVRGRETYEMLLKIKESLELMQYLPQHTIETYRQQQQQQH

QHLLQKQ

Human p73 tetramerization domain amino acid
sequence (348-399)
(SEQ ID NO: 127)
RHGDEDTYYLQVRGRENFEILMKLKESLELMELVPQPLVDSYRQQQQLLQ

RP.

Human HNRNPC tetramerization domain amino acid
sequence (194-220)
(SEQ ID NO: 128)
QAIKKELTQIKQKVDSLLENLEKIEKE Human SNAP-23 tetramerization domain amino acid
sequence (23-76)
(SEQ ID NO: 129)
STRRILGLAIESQDAGIKTITMLDEQKEQLNRIEEGLDQINKDMRETEKT

LTEL

Human Stefin B tetramerizaiton domain amino acid
sequence (2-98)
(SEQ ID NO: 130)
MCGAPSATQPATAETQHIADQVRSQLEEKENKKFPVFKAVSFKSQVVAGT

NYFIKVHVGDEDFVHLRVFQSLPHENKPLTLSNYQTNKAKHDELTYF

KCNQ4 tetramerizaiton domain amino acid sequence
(611-640)
(SEQ ID NO: 131)
DEISMMGRVVKVEKQVQSIEHKLDLLLGFY CBFA2T1 tetramerizaiton domain amino acid sequence
(462-521)
(SEQ ID NO: 132)
TVAEAKRQAAEDALAVINQQEDSSESCWNCGRKASETCSGCNTARYCGSF

CQHKDWEKHH

In some embodiments, a SADA polypeptide is or comprises a tetramerization domain of p53, p63, p73, heterogeneous nuclear Ribonucleoprotein C (hnRNPC), N-terminal domain of Synaptosomal-associated protein 23 (SNAP-23), Stefin B (Cystatin B), Potassium voltage-gated channel subfamily KQT member 4 (KCNQ4), or Cyclin-D-related protein (CBFA2T1). In some embodiments, a SADA polypeptide is or comprises a sequence that is at least 75%, 80%, 85%, 90%, 91%, 92%, 93%, 94%, 95%, 96%, 97%, 98%, 99% or 100% identical to a sequence as set forth in any one of SEQ ID NOs: 125-132.

Fc Modifications. In some embodiments, the anti-CD33 antibodies of the present technology comprise a variant Fc region, wherein said variant Fc region comprises at least one amino acid modification relative to a wild-type Fc region (or the parental Fc region), such that said molecule has an altered affinity for an Fc receptor (e.g., an FcγR), provided that said variant Fc region does not have a substitution at positions that make a direct contact with Fc receptor based on crystallographic and structural analysis of Fc-Fc receptor interactions such as those disclosed by Sondermann et al., *Nature*, 406:267-273 (2000). Examples of positions within the Fc region that make a direct contact with an Fc receptor such as an FcγR, include amino acids 234-239 (hinge region), amino acids 265-269 (B/C loop), amino acids 297-299 (C7E loop), and amino acids 327-332 (F/G) loop.

In some embodiments, an anti-CD33 antibody of the present technology has an altered affinity for activating and/or inhibitory receptors, having a variant Fc region with one or more amino acid modifications, wherein said one or more amino acid modification is a N297 substitution with alanine, or a K322 substitution with alanine.

Glycosylation Modifications. In some embodiments, anti-CD33 antibodies of the present technology have an Fc region with variant glycosylation as compared to a parent Fc region. In some embodiments, variant glycosylation includes the absence of fucose; in some embodiments, variant glycosylation results from expression in GnT1-deficient CHO cells.

In some embodiments, the antibodies of the present technology, may have a modified glycosylation site relative to an appropriate reference antibody that binds to an antigen of interest (e.g., CD33), without altering the functionality of the antibody, e.g., binding activity to the antigen. As used herein, "glycosylation sites" include any specific amino acid sequence in an antibody to which an oligosaccharide (i.e., carbohydrates containing two or more simple sugars linked together) will specifically and covalently attach.

Oligosaccharide side chains are typically linked to the backbone of an antibody via either N- or O-linkages. N-linked glycosylation refers to the attachment of an oligosaccharide moiety to the side chain of an asparagine residue. O-linked glycosylation refers to the attachment of an oligosaccharide moiety to a hydroxyamino acid, e.g., serine, threonine. For example, an Fc-glycoform (hCD33-IgGln) that lacks certain oligosaccharides including fucose and terminal N-acetylglucosamine may be produced in special CHO cells and exhibit enhanced ADCC effector function.

In some embodiments, the carbohydrate content of an immunoglobulin-related composition disclosed herein is modified by adding or deleting a glycosylation site. Methods for modifying the carbohydrate content of antibodies are well known in the art and are included within the present technology, see, e.g., U.S. Pat. No. 6,218,149; EP 0359096B1; U.S. Patent Publication No. US 2002/0028486; International Patent Application Publication WO 03/035835; U.S. Patent Publication No. 2003/0115614; U.S. Pat. Nos. 6,218,149; 6,472,511; all of which are incorporated herein by reference in their entirety. In some embodiments, the carbohydrate content of an antibody (or relevant portion or component thereof) is modified by deleting one or more endogenous carbohydrate moieties of the antibody. In some certain embodiments, the present technology includes deleting the glycosylation site of the Fc region of an antibody, by modifying position 297 from asparagine to alanine.

Engineered glycoforms may be useful for a variety of purposes, including but not limited to enhancing or reducing effector function. Engineered glycoforms may be generated by any method known to one skilled in the art, for example by using engineered or variant expression strains, by co-expression with one or more enzymes, for example N-acetylglucosaminyltransferase III (GnTIII), by expressing a molecule comprising an Fc region in various organisms or cell lines from various organisms, or by modifying carbohydrate(s) after the molecule comprising Fc region has been expressed. Methods for generating engineered glycoforms are known in the art, and include but are not limited to those described in Umana et al., 1999, *Nat. Biotechnol.* 17: 176-180; Davies et al., 2001, *Biotechnol. Bioeng.* 74:288-294; Shields et al., 2002, *J. Biol. Chem.* 277:26733-26740; Shinkawa et al., 2003, *J. Biol. Chem.* 278:3466-3473; U.S. Pat. No. 6,602,684; U.S. patent application Ser. No. 10/277, 370; U.S. patent application Ser. No. 10/113,929; International Patent Application Publications WO 00/61739A1; WO 01/292246A1; WO 02/311140A1; WO 02/30954A1; POTILLEGENT™ technology (Biowa, Inc. Princeton, N.J.); GLYCOMAB™ glycosylation engineering technology (GLYCART biotechnology AG, Zurich, Switzerland); each of which is incorporated herein by reference in its entirety. See, e.g., International Patent Application Publication WO 00/061739; U.S. Patent Application Publication No. 2003/0115614; Okazaki et al., 2004, *JMB*, 336: 1239-49.

Fusion Proteins. In one embodiment, the anti-CD33 antibody of the present technology is a fusion protein. The anti-CD33 antibodies of the present technology, when fused to a second protein, can be used as an antigenic tag. Examples of domains that can be fused to polypeptides include not only heterologous signal sequences, but also other heterologous functional regions. The fusion does not necessarily need to be direct, but can occur through linker sequences. Moreover, fusion proteins of the present technology can also be engineered to improve characteristics of the anti-CD33 antibodies. For instance, a region of additional amino acids, particularly charged amino acids, can be added to the N-terminus of the anti-CD33 antibody to improve stability and persistence during purification from the host cell or subsequent handling and storage. Also, peptide moieties can be added to an anti-CD33 antibody to facilitate purification. Such regions can be removed prior to final preparation of the anti-CD33 antibody. The addition of peptide moieties to facilitate handling of polypeptides are familiar and routine techniques in the art. The anti-CD33 antibody of the present technology can be fused to marker sequences, such as a peptide which facilitates purification of the fused polypeptide. In select embodiments, the marker amino acid sequence is a hexa-histidine peptide (SEQ ID NO: 160), such as the tag provided in a pQE vector (QIAGEN, Inc., Chatsworth, Calif.), among others, many of which are commercially available. As described in Gentz et al., *Proc. Natl. Acad. Sci. USA* 86: 821-824, 1989, for instance, hexa-histidine (SEQ ID NO: 160) provides for convenient purification of the fusion protein. Another peptide tag useful for purification, the "HA" tag, corresponds to an epitope derived from the influenza hemagglutinin protein. Wilson et al., *Cell* 37: 767, 1984.

Thus, any of these above fusion proteins can be engineered using the polynucleotides or the polypeptides of the present technology. Also, in some embodiments, the fusion proteins described herein show an increased half-life in vivo.

Fusion proteins having disulfide-linked dimeric structures (due to the IgG) can be more efficient in binding and neutralizing other molecules compared to the monomeric secreted protein or protein fragment alone. Fountoulakis et al., *J. Biochem.* 270: 3958-3964, 1995.

Similarly, EP-A-0 464 533 (Canadian counterpart 2045869) discloses fusion proteins comprising various portions of constant region of immunoglobulin molecules together with another human protein or a fragment thereof.

In many cases, the Fc part in a fusion protein is beneficial in therapy and diagnosis, and thus can result in, e.g., improved pharmacokinetic properties. See EP-A 0232 262. Alternatively, deleting or modifying the Fc part after the fusion protein has been expressed, detected, and purified, may be desired. For example, the Fc portion can hinder therapy and diagnosis if the fusion protein is used as an antigen for immunizations. In drug discovery, e.g., human proteins, such as hIL-5, have been fused with Fc portions for the purpose of high-throughput screening assays to identify antagonists of hIL-5. Bennett et al., *J. Molecular Recognition* 8: 52-58, 1995; Johanson et al., *J. Biol. Chem.,* 270: 9459-9471, 1995.

Labeled Anti-CD33 antibodies. In one embodiment, the anti-CD33 antibody of the present technology is coupled with a label moiety, i.e., detectable group. The particular label or detectable group conjugated to the anti-CD33 antibody is not a critical aspect of the technology, so long as it does not significantly interfere with the specific binding of the anti-CD33 antibody of the present technology to the CD33 protein. The detectable group can be any material having a detectable physical or chemical property. Such detectable labels have been well-developed in the field of immunoassays and imaging. In general, almost any label useful in such methods can be applied to the present technology. Thus, a label is any composition detectable by spectroscopic, photochemical, biochemical, immunochemical, electrical, optical or chemical means. Labels useful in the practice of the present technology include magnetic beads (e.g., Dynabeads™), fluorescent dyes (e.g., fluorescein isothiocyanate, Texas red, rhodamine, and the like), radiolabels (e.g., $^{3}$H, $^{14}$C, $^{35}$S, $^{125}$I, $^{121}$I, $^{131}$I, $^{112}$In, $^{99}$mTc), other imaging agents such as microbubbles (for ultrasound imaging), $^{18}$F, $^{11}$C, $^{15}$O, (for Positron emission tomography), $^{99m}$TC, $^{111}$In (for Single photon emission tomography), enzymes (e.g., horse radish peroxidase, alkaline phosphatase and others commonly used in an ELISA), and calorimetric labels such as colloidal gold or colored glass or plastic (e.g., polystyrene, polypropylene, latex, and the like) beads. Patents that describe the use of such labels include U.S. Pat. Nos. 3,817,837; 3,850,752; 3,939,350; 3,996,345; 4,277, 437; 4,275,149; and 4,366,241, each incorporated herein by reference in their entirety and for all purposes. See also Handbook of Fluorescent Probes and Research Chemicals ($6^{th}$ Ed., Molecular Probes, Inc., Eugene Oreg.).

The label can be coupled directly or indirectly to the desired component of an assay according to methods well known in the art. As indicated above, a wide variety of labels can be used, with the choice of label depending on factors such as required sensitivity, ease of conjugation with the compound, stability requirements, available instrumentation, and disposal provisions.

Non-radioactive labels are often attached by indirect means. Generally, a ligand molecule (e.g., biotin) is covalently bound to the molecule. The ligand then binds to an anti-ligand (e.g., streptavidin) molecule which is either inherently detectable or covalently bound to a signal system, such as a detectable enzyme, a fluorescent compound, or a chemiluminescent compound. A number of ligands and anti-ligands can be used. Where a ligand has a natural anti-ligand, e.g., biotin, thyroxine, and cortisol, it can be used in conjunction with the labeled, naturally-occurring anti-ligands. Alternatively, any haptenic or antigenic compound can be used in combination with an antibody, e.g., an anti-CD33 antibody.

The molecules can also be conjugated directly to signal generating compounds, e.g., by conjugation with an enzyme or fluorophore. Enzymes of interest as labels will primarily be hydrolases, particularly phosphatases, esterases and glycosidases, or oxidoreductases, particularly peroxidases. Fluorescent compounds useful as labeling moieties, include, but are not limited to, e.g., fluorescein and its derivatives, rhodamine and its derivatives, dansyl, umbelliferone, and the like. Chemiluminescent compounds useful as labeling moieties, include, but are not limited to, e.g., luciferin, and 2,3-dihydrophthalazinediones, e.g., luminol. For a review of various labeling or signal-producing systems which can be used, see U.S. Pat. No. 4,391,904.

Means of detecting labels are well known to those of skill in the art. Thus, for example, where the label is a radioactive label, means for detection include a scintillation counter or photographic film as in autoradiography. Where the label is a fluorescent label, it can be detected by exciting the fluorochrome with the appropriate wavelength of light and detecting the resulting fluorescence. The fluorescence can be detected visually, by means of photographic film, by the use of electronic detectors such as charge coupled devices (CCDs) or photomultipliers and the like. Similarly, enzymatic labels can be detected by providing the appropriate substrates for the enzyme and detecting the resulting reaction product. Finally, simple colorimetric labels can be detected simply by observing the color associated with the label. Thus, in various dipstick assays, conjugated gold often appears pink, while various conjugated beads appear the color of the bead.

Some assay formats do not require the use of labeled components. For instance, agglutination assays can be used to detect the presence of the target antibodies, e.g., the anti-CD33 antibodies. In this case, antigen-coated particles are agglutinated by samples comprising the target antibodies. In this format, none of the components need be labeled and the presence of the target antibody is detected by simple visual inspection.

B. Identifying and Characterizing the Anti-CD33 Antibodies of the Present Technology Methods for identifying and/or screening the anti-CD33 antibodies of the present technology. Methods useful to identify and screen antibodies against CD33 polypeptides for those that possess the desired specificity to CD33 protein (e.g., those that bind to the IgC2 domain of CD33) include any immunologically-mediated techniques known within the art. Components of an immune response can be detected in vitro by various methods that are well known to those of ordinary skill in the art. For example, (1) cytotoxic T lymphocytes can be incubated with radioactively labeled target cells and the lysis of these target cells detected by the release of radioactivity; (2) helper T lymphocytes can be incubated with antigens and antigen presenting cells and the synthesis and secretion of cytokines measured by standard methods (Windhagen A et al., *Immunity,* 2: 373-80, 1995); (3) antigen presenting cells can be incubated with whole protein antigen and the presentation of that antigen on MHC detected by either T lymphocyte activation assays or biophysical methods (Harding et al., *Proc. Natl. Acad. Sci.,* 86: 4230-4, 1989); (4) mast cells can be incubated with reagents that cross-link their Fc-epsilon receptors and histamine release measured by enzyme immunoassay (Siraganian et al., *TIPS,* 4: 432-437, 1983); and (5) enzyme-linked immunosorbent assay (ELISA).

Similarly, products of an immune response in either a model organism (e.g., mouse) or a human subject can also be detected by various methods that are well known to those of ordinary skill in the art. For example, (1) the production of antibodies in response to vaccination can be readily detected by standard methods currently used in clinical laboratories, e.g., an ELISA; (2) the migration of immune cells to sites of inflammation can be detected by scratching the surface of skin and placing a sterile container to capture the migrating cells over scratch site (Peters et al., *Blood,* 72: 1310-5, 1988); (3) the proliferation of peripheral blood mononuclear cells (PBMCs) in response to mitogens or mixed lymphocyte reaction can be measured using $^3$H-thymidine; (4) the phagocytic capacity of granulocytes, macrophages, and other phagocytes in PBMCs can be measured by placing PBMCs in wells together with labeled particles (Peters et al., *Blood,* 72: 1310-5, 1988); and (5) the differentiation of immune system cells can be measured by labeling PBMCs with antibodies to CD molecules such as CD4 and CD8 and measuring the fraction of the PBMCs expressing these markers.

In one embodiment, anti-CD33 antibodies of the present technology are selected using display of CD33 peptides on the surface of replicable genetic packages. See, e.g., U.S. Pat. Nos. 5,514,548; 5,837,500; 5,871,907; 5,885,793; 5,969,108; 6,225,447; 6,291,650; 6,492,160; EP 585 287; EP 605522; EP 616640; EP 1024191; EP 589 877; EP 774 511; EP 844 306. Methods useful for producing/selecting a filamentous bacteriophage particle containing a phagemid genome encoding for a binding molecule with a desired specificity has been described. See, e.g., EP 774 511; U.S. Pat. Nos. 5,871,907; 5,969,108; 6,225,447; 6,291,650; 6,492,160.

In some embodiments, anti-CD33 antibodies of the present technology are selected using display of CD33 peptides on the surface of a yeast host cell. Methods useful for the isolation of scFv polypeptides by yeast surface display have been described by Kieke et al., *Protein Eng.* 1997 November; 10(11): 1303-10.

In some embodiments, anti-CD33 antibodies of the present technology are selected using ribosome display. Methods useful for identifying ligands in peptide libraries using ribosome display have been described by Mattheakis et al., *Proc. Natl. Acad. Sci. USA* 91: 9022-26, 1994; and Hanes et al., *Proc. Natl. Acad. Sci. USA* 94: 4937-42, 1997.

In certain embodiments, anti-CD33 antibodies of the present technology are selected using tRNA display of CD33 peptides. Methods useful for in vitro selection of ligands using tRNA display have been described by Merryman et al., *Chem. Biol.,* 9: 741-46, 2002.

In one embodiment, anti-CD33 antibodies of the present technology are selected using RNA display. Methods useful for selecting peptides and proteins using RNA display libraries have been described by Roberts et al. *Proc. Natl. Acad. Sci. USA,* 94: 12297-302, 1997; and Nemoto et al., *FEBS Lett.,* 414: 405-8, 1997. Methods useful for selecting peptides and proteins using unnatural RNA display libraries have been described by Frankel et al., *Curr. Opin. Struct. Biol.,* 13: 506-12, 2003.

In some embodiments, anti-CD33 antibodies of the present technology are expressed in the periplasm of gram negative bacteria and mixed with labeled CD33 protein. See WO 02/34886. In clones expressing recombinant polypeptides with affinity for CD33 protein, the concentration of the labeled CD33 protein bound to the anti-CD33 antibodies is increased and allows the cells to be isolated from the rest of the library as described in Harvey et al., *Proc. Natl. Acad. Sci.* 22: 9193-98 2004 and U.S. Pat. Publication No. 2004/0058403.

After selection of the desired anti-CD33 antibodies, it is contemplated that said antibodies can be produced in large volume by any technique known to those skilled in the art, e.g., prokaryotic or eukaryotic cell expression and the like. The anti-CD33 antibodies which are, e.g., but not limited to, anti-CD33 hybrid antibodies or fragments can be produced by using conventional techniques to construct an expression vector that encodes an antibody heavy chain in which the CDRs and, if necessary, a minimal portion of the variable region framework, that are required to retain original species antibody binding specificity (as engineered according to the techniques described herein) are derived from the originating species antibody and the remainder of the antibody is derived from a target species immunoglobulin which can be manipulated as described herein, thereby producing a vector for the expression of a hybrid antibody heavy chain.

Measurement of CD33 Binding. In some embodiments, a CD33 binding assay refers to an assay format wherein CD33 protein and an anti-CD33 antibody are mixed under conditions suitable for binding between the CD33 protein and the anti-CD33 antibody and assessing the amount of binding between the CD33 protein and the anti-CD33 antibody. The amount of binding is compared with a suitable control, which can be the amount of binding in the absence of the CD33 protein, the amount of the binding in the presence of a non-specific immunoglobulin composition, or both. The amount of binding can be assessed by any suitable method. Binding assay methods include, e.g., ELISA, radioimmunoassays, scintillation proximity assays, fluorescence energy transfer assays, liquid chromatography, membrane filtration assays, and the like. Biophysical assays for the direct measurement of CD33 protein binding to anti-CD33 antibody are, e.g., nuclear magnetic resonance, fluorescence, fluorescence polarization, surface plasmon resonance (BIA-CORE chips) and the like. Specific binding is determined by standard assays known in the art, e.g., radioligand binding assays, ELISA, FRET, immunoprecipitation, SPR, NMR (2D-NMR), mass spectroscopy and the like. If the specific binding of a candidate anti-CD33 antibody is at least 1 percent greater than the binding observed in the absence of the candidate anti-CD33 antibody, the candidate anti-CD33 antibody is useful as an anti-CD33 antibody of the present technology. In some embodiments, the CD33 protein is a short isoform of CD33 (a splice variant lacking the IgV domain).

Uses of the Anti-CD33 Antibodies of the Present Technology

General. The anti-CD33 antibodies of the present technology are useful in methods known in the art relating to the localization and/or quantitation of CD33 protein (e.g., for use in measuring levels of the CD33 protein within appropriate physiological samples, for use in diagnostic methods, for use in imaging the polypeptide, and the like). Antibodies of the present technology are useful to isolate a CD33 protein by standard techniques, such as affinity chromatography or immunoprecipitation. An anti-CD33 antibody of the present technology can facilitate the purification of natural immunoreactive CD33 proteins from biological samples, e.g., mammalian sera or cells as well as recombinantly-produced immunoreactive CD33 proteins expressed in a host system. Moreover, anti-CD33 antibodies can be used to detect an immunoreactive CD33 protein (e.g., in plasma, a cellular lysate or cell supernatant) in order to evaluate the abundance and pattern of expression of the immunoreactive polypeptide. The anti-CD33 antibodies of the present technology can be used diagnostically to monitor immunoreactive CD33 protein levels in tissue as part of a clinical testing procedure, e.g., to determine the efficacy of a given treatment regimen. As noted above, the detection can be facilitated by coupling (i.e., physically linking) the anti-CD33 antibodies of the present technology to a detectable substance.

Detection of CD33 protein. An exemplary method for detecting the presence or absence of an immunoreactive CD33 protein in a biological sample involves obtaining a biological sample from a test subject and contacting the biological sample with an anti-CD33 antibody of the present technology capable of detecting an immunoreactive CD33 protein such that the presence of an immunoreactive CD33 protein is detected in the biological sample. Detection may be accomplished by means of a detectable label attached to the antibody.

The term "labeled" with regard to the anti-CD33 antibody is intended to encompass direct labeling of the antibody by coupling (i.e., physically linking) a detectable substance to the antibody, as well as indirect labeling of the antibody by reactivity with another compound that is directly labeled, such as a secondary antibody. Examples of indirect labeling include detection of a primary antibody using a fluorescently-labeled secondary antibody and end-labeling of a DNA probe with biotin such that it can be detected with fluorescently-labeled streptavidin.

In some embodiments, the anti-CD33 antibodies disclosed herein are conjugated to one or more detectable labels. For such uses, anti-CD33 antibodies may be detectably labeled by covalent or non-covalent attachment of a chromogenic, enzymatic, radioisotopic, isotopic, fluorescent, toxic, chemiluminescent, nuclear magnetic resonance contrast agent or other label.

Examples of suitable chromogenic labels include diaminobenzidine and 4-hydroxyazo-benzene-2-carboxylic acid. Examples of suitable enzyme labels include malate dehydrogenase, staphylococcal nuclease, $\Delta$-5-steroid isomerase, yeast-alcohol dehydrogenase, $\alpha$-glycerol phosphate dehydrogenase, triose phosphate isomerase, peroxidase, alkaline phosphatase, asparaginase, glucose oxidase, $\beta$-galactosidase, ribonuclease, urease, catalase, glucose-6-phosphate dehydrogenase, glucoamylase, and acetylcholine esterase.

Examples of suitable radioisotopic labels include $^3$H, $^{111}$In, $^{125}$I, $^{131}$I, $^{32}$P, $^{35}$S, $^{14}$C, $^{51}$Cr, $^{57}$To, $^{58}$Co, $^{59}$Fe, $^{75}$Se, $^{152}$Eu, $^{90}$Y, $^{67}$Cu, $^{217}$Ci, $^{211}$At, $^{212}$Pb, $^{47}$Sc, $^{109}$Pd, etc. $^{111}$In in an exemplary isotope where in vivo imaging is used since its avoids the problem of dehalogenation of the $^{125}$I or $^{131}$I-labeled CD33-binding antibodies by the liver. In addition, this isotope has a more favorable gamma emission energy for imaging (Perkins et al, *Eur. J. Nucl. Med.* 70:296-301 (1985); Carasquillo et al., *J. Nucl. Med.* 25:281-287 (1987)). For example, $^{111}$In coupled to monoclonal antibodies with 1-(P-isothiocyanatobenzyl)-DPTA exhibits little uptake in non-tumorous tissues, particularly the liver, and enhances specificity of tumor localization (Esteban et al., *J. Nucl. Med.* 28:861-870 (1987)). Examples of suitable non-radioactive isotopic labels include $^{157}$Gd, $^{55}$Mn, $^{162}$Dy, $^{52}$Tr, and $^{56}$Fe.

Examples of suitable fluorescent labels include an $^{152}$Eu label, a fluorescein label, an isothiocyanate label, a rhodamine label, a phycoerythrin label, a phycocyanin label, an allophycocyanin label, a Green Fluorescent Protein (GFP) label, an o-phthaldehyde label, and a fluorescamine label. Examples of suitable toxin labels include diphtheria toxin, ricin, and cholera toxin.

Examples of chemiluminescent labels include a luminol label, an isoluminol label, an aromatic acridinium ester label, an imidazole label, an acridinium salt label, an oxalate ester label, a luciferin label, a luciferase label, and an aequorin label. Examples of nuclear magnetic resonance contrasting agents include heavy metal nuclei such as Gd, Mn, and iron.

The detection method of the present technology can be used to detect an immunoreactive CD33 protein in a biological sample in vitro as well as in vivo. In vitro techniques for detection of an immunoreactive CD33 protein include enzyme linked immunosorbent assays (ELISAs), Western blots, immunoprecipitations, radioimmunoassay, and immunofluorescence. Furthermore, in vivo techniques for detection of an immunoreactive CD33 protein include introducing into a subject a labeled anti-CD33 antibody. For example, the anti-CD33 antibody can be labeled with a radioactive marker whose presence and location in a subject can be detected by standard imaging techniques. In one embodiment, the biological sample contains CD33 protein molecules from the test subject.

Immunoassay and Imaging. An anti-CD33 antibody of the present technology can be used to assay immunoreactive CD33 protein levels in a biological sample (e.g., human plasma) using antibody-based techniques. For example, protein expression in tissues can be studied with classical immunohistological methods. Jalkanen, M. et al., *J. Cell. Biol.* 101: 976-985, 1985; Jalkanen, M. et al., *J. Cell. Biol.* 105: 3087-3096, 1987. Other antibody-based methods useful for detecting protein gene expression include immunoassays, such as the enzyme linked immunosorbent assay (ELISA) and the radioimmunoassay (MA). Suitable antibody assay labels are known in the art and include enzyme labels, such as, glucose oxidase, and radioisotopes or other radioactive agent, such as iodine ($^{125}$I, $^{121}$I, $^{131}$I), carbon ($^{14}$C), sulfur ($^{35}$S), tritium ($^3$H), indium ($^{112}$In), and technetium ($^{99}$mTc), and fluorescent labels, such as fluorescein, rhodamine, and green fluorescent protein (GFP), as well as biotin.

In addition to assaying immunoreactive CD33 protein levels in a biological sample, anti-CD33 antibodies of the present technology may be used for in vivo imaging of CD33. Antibodies useful for this method include those detectable by X-radiography, NMR or ESR. For X-radiography, suitable labels include radioisotopes such as barium or cesium, which emit detectable radiation but are not overtly harmful to the subject. Suitable markers for NMR and ESR include those with a detectable characteristic spin, such as deuterium, which can be incorporated into the anti-CD33 antibodies by labeling of nutrients for the relevant scFv clone.

An anti-CD33 antibody which has been labeled with an appropriate detectable imaging moiety, such as a radioisotope (e.g., $^{131}$I, $^{112}$In, $^{99}$mTc), a radio-opaque substance, or a material detectable by nuclear magnetic resonance, is introduced (e.g., parenterally, subcutaneously, or intraperitoneally) into the subject. It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 millicuries of $^{99}$mTc. The labeled anti-CD33 antibody will then accumulate at the location of cells which contain the specific target polypeptide. For example, labeled anti-CD33 antibodies of the present technology will accumulate within the subject in cells and tissues in which the CD33 protein has localized.

Thus, the present technology provides a diagnostic method of a medical condition, which involves: (a) assaying the expression of immunoreactive CD33 protein by measuring binding of an anti-CD33 antibody of the present technology in cells or body fluid of an individual; (b) comparing the amount of immunoreactive CD33 protein present in the sample with a standard reference, wherein an increase or decrease in immunoreactive CD33 protein levels compared to the standard is indicative of a medical condition.

Affinity Purification. The anti-CD33 antibodies of the present technology may be used to purify immunoreactive CD33 protein from a sample. In some embodiments, the antibodies are immobilized on a solid support. Examples of such solid supports include plastics such as polycarbonate, complex carbohydrates such as agarose and sepharose, acrylic resins and such as polyacrylamide and latex beads. Techniques for coupling antibodies to such solid supports are well known in the art (Weir et al., "Handbook of Experimental Immunology" 4th Ed., Blackwell Scientific Publications, Oxford, England, Chapter 10 (1986); Jacoby et al., *Meth. Enzym.* 34 Academic Press, N.Y. (1974)).

The simplest method to bind the antigen to the antibody-support matrix is to collect the beads in a column and pass the antigen solution down the column. The efficiency of this method depends on the contact time between the immobilized antibody and the antigen, which can be extended by using low flow rates. The immobilized antibody captures the antigen as it flows past. Alternatively, an antigen can be contacted with the antibody-support matrix by mixing the antigen solution with the support (e.g., beads) and rotating or rocking the slurry, allowing maximum contact between the antigen and the immobilized antibody. After the binding reaction has been completed, the slurry is passed into a column for collection of the beads. The beads are washed using a suitable washing buffer and then the pure or substantially pure antigen is eluted.

An antibody or polypeptide of interest can be conjugated to a solid support, such as a bead. In addition, a first solid support such as a bead can also be conjugated, if desired, to a second solid support, which can be a second bead or other support, by any suitable means, including those disclosed herein for conjugation of a polypeptide to a support. Accordingly, any of the conjugation methods and means disclosed herein with reference to conjugation of a polypeptide to a solid support can also be applied for conjugation of a first support to a second support, where the first and second solid support can be the same or different.

Appropriate linkers, which can be cross-linking agents, for use for conjugating a polypeptide to a solid support include a variety of agents that can react with a functional group present on a surface of the support, or with the polypeptide, or both. Reagents useful as cross-linking agents include homo-bi-functional and, in particular, hetero-bi-functional reagents. Useful bi-functional cross-linking agents include, but are not limited to, N-SIAB, dimaleimide, DTNB, N-SATA, N-SPDP, SMCC and 6-HYNIC. A cross-linking agent can be selected to provide a selectively cleavable bond between a polypeptide and the solid support. For example, a photolabile cross-linker, such as 3-amino-(2-nitrophenyl)propionic acid can be employed as a means for cleaving a polypeptide from a solid support. (Brown et al., *Mol. Divers*, pp, 4-12 (1995); Rothschild et al., *Nucl. Acids Res.*, 24:351-66 (1996); and U.S. Pat. No. 5,643,722). Other cross-linking reagents are well-known in the art. (See, e.g., Wong (1991), supra; and Hermanson (1996), supra).

An antibody or polypeptide can be immobilized on a solid support, such as a bead, through a covalent amide bond formed between a carboxyl group functionalized bead and the amino terminus of the polypeptide or, conversely, through a covalent amide bond formed between an amino group functionalized bead and the carboxyl terminus of the polypeptide. In addition, a bi-functional trityl linker can be attached to the support, e.g., to the 4-nitrophenyl active ester on a resin, such as a Wang resin, through an amino group or a carboxyl group on the resin via an amino resin. Using a bi-functional trityl approach, the solid support can require treatment with a volatile acid, such as formic acid or trifluoroacetic acid to ensure that the polypeptide is cleaved and can be removed. In such a case, the polypeptide can be deposited as a beadless patch at the bottom of a well of a solid support or on the flat surface of a solid support. After addition of a matrix solution, the polypeptide can be desorbed into a MS.

Hydrophobic trityl linkers can also be exploited as acid-labile linkers by using a volatile acid or an appropriate matrix solution, e.g., a matrix solution containing 3-HPA, to cleave an amino linked trityl group from the polypeptide. Acid lability can also be changed. For example, trityl, monomethoxytrityl, dimethoxytrityl or trimethoxytrityl can be changed to the appropriate p-substituted, or more acid-labile tritylamine derivatives, of the polypeptide, i.e., trityl ether and tritylamine bonds can be made to the polypeptide. Accordingly, a polypeptide can be removed from a hydrophobic linker, e.g., by disrupting the hydrophobic attraction or by cleaving tritylether or tritylamine bonds under acidic conditions, including, if desired, under typical MS conditions, where a matrix, such as 3-HPA acts as an acid.

Orthogonally cleavable linkers can also be useful for binding a first solid support, e.g., a bead to a second solid support, or for binding a polypeptide of interest to a solid support. Using such linkers, a first solid support, e.g., a bead, can be selectively cleaved from a second solid support, without cleaving the polypeptide from the support; the polypeptide then can be cleaved from the bead at a later time. For example, a disulfide linker, which can be cleaved using a reducing agent, such as DTT, can be employed to bind a bead to a second solid support, and an acid cleavable bi-functional trityl group could be used to immobilize a polypeptide to the support. As desired, the linkage of the polypeptide to the solid support can be cleaved first, e.g., leaving the linkage between the first and second support intact. Trityl linkers can provide a covalent or hydrophobic conjugation and, regardless of the nature of the conjugation, the trityl group is readily cleaved in acidic conditions.

For example, a bead can be bound to a second support through a linking group which can be selected to have a length and a chemical nature such that high density binding of the beads to the solid support, or high density binding of the polypeptides to the beads, is promoted. Such a linking group can have, e.g., "tree-like" structure, thereby providing a multiplicity of functional groups per attachment site on a solid support. Examples of such linking group; include polylysine, polyglutamic acid, penta-erythrole and tris-hydroxy-aminomethane.

Noncovalent Binding Association. An antibody or polypeptide can be conjugated to a solid support, or a first solid support can also be conjugated to a second solid support, through a noncovalent interaction. For example, a magnetic bead made of a ferromagnetic material, which is capable of being magnetized, can be attracted to a magnetic solid support, and can be released from the support by removal of the magnetic field. Alternatively, the solid support can be provided with an ionic or hydrophobic moiety, which can allow the interaction of an ionic or hydrophobic moiety, respectively, with a polypeptide, e.g., a polypeptide containing an attached trityl group or with a second solid support having hydrophobic character.

A solid support can also be provided with a member of a specific binding pair and, therefore, can be conjugated to a polypeptide or a second solid support containing a complementary binding moiety. For example, a bead coated with avidin or with streptavidin can be bound to a polypeptide having a biotin moiety incorporated therein, or to a second solid support coated with biotin or derivative of biotin, such as iminobiotin.

It should be recognized that any of the binding members disclosed herein or otherwise known in the art can be reversed. Thus, biotin, e.g., can be incorporated into either a polypeptide or a solid support and, conversely, avidin or other biotin binding moiety would be incorporated into the support or the polypeptide, respectively. Other specific binding pairs contemplated for use herein include, but are not limited to, hormones and their receptors, enzyme, and their substrates, a nucleotide sequence and its complementary sequence, an antibody and the antigen to which it interacts specifically, and other such pairs knows to those skilled in the art.

A. Diagnostic Uses of Anti-CD33 Antibodies of the Present Technology

General. The anti-CD33 antibodies of the present technology are useful in diagnostic methods. As such, the present technology provides methods using the antibodies in the diagnosis of CD33 activity in a subject. Anti-CD33 antibodies of the present technology may be selected such that they have any level of epitope binding specificity and very high binding affinity to a CD33 protein. In general, the higher the binding affinity of an antibody the more stringent wash conditions can be performed in an immunoassay to remove nonspecifically bound material without removing target polypeptide. Accordingly, anti-CD33 antibodies of the present technology useful in diagnostic assays usually have binding affinities of about $10^8 M^{-1}$, $10^9 M^{-1}$, $10^{10} M^{-1}$, $10^{11} M^{-1}$ or $10^{12} M^{-1}$. Further, it is desirable that anti-CD33 antibodies used as diagnostic reagents have a sufficient kinetic on-rate to reach equilibrium under standard conditions in at least 12 h, at least five (5) h, or at least one (1) hour.

Anti-CD33 antibodies can be used to detect an immunoreactive CD33 protein in a variety of standard assay formats. Such formats include immunoprecipitation, Western blotting, ELISA, radioimmunoassay, and immunometric assays. See Harlow & Lane, *Antibodies, A Laboratory Manual* (Cold Spring Harbor Publications, New York, 1988); U.S. Pat. Nos. 3,791,932; 3,839,153; 3,850,752; 3,879,262; 4,034,074, 3,791,932; 3,817,837; 3,839,153; 3,850,752; 3,850,578; 3,853,987; 3,867,517; 3,879,262; 3,901,654; 3,935,074; 3,984,533; 3,996,345; 4,034,074; and 4,098,876. Biological samples can be obtained from any tissue or body fluid of a subject. In certain embodiments, the subject is at an early stage of cancer. In one embodiment, the early stage of cancer is determined by the level or expression pattern of CD33 protein in a sample obtained from the subject. In certain embodiments, the sample is selected from the group consisting of urine, blood, serum, plasma, saliva, amniotic fluid, cerebrospinal fluid (CSF), and biopsied body tissue.

Immunometric or sandwich assays are one format for the diagnostic methods of the present technology. See U.S. Pat. Nos. 4,376,110, 4,486,530, 5,914,241, and 5,965,375. Such assays use one antibody, e.g., an anti-CD33 antibody or a population of anti-CD33 antibodies immobilized to a solid phase, and another anti-CD33 antibody or a population of anti-CD33 antibodies in solution. Typically, the solution anti-CD33 antibody or population of anti-CD33 antibodies is labeled. If an antibody population is used, the population can contain antibodies binding to different epitope specificities within the target polypeptide. Accordingly, the same population can be used for both solid phase and solution antibody. If anti-CD33 monoclonal antibodies are used, first and second CD33 monoclonal antibodies having different binding specificities are used for the solid and solution phase. Solid phase (also referred to as "capture") and solution (also referred to as "detection") antibodies can be contacted with target antigen in either order or simultaneously. If the solid phase antibody is contacted first, the assay is referred to as being a forward assay. Conversely, if the solution antibody is contacted first, the assay is referred to as being a reverse assay. If the target is contacted with both antibodies simultaneously, the assay is referred to as a simultaneous assay. After contacting the CD33 protein with the anti-CD33 antibody, a sample is incubated for a period that usually varies from about 10 min to about 24 hr and is usually about 1 hr. A wash step is then performed to remove components of the sample not specifically bound to the anti-CD33 antibody being used as a diagnostic reagent. When solid phase and solution antibodies are bound in separate steps, a wash can be performed after either or both binding steps. After washing, binding is quantified, typically by detecting a label linked to the solid phase through binding of labeled solution antibody. Usually for a given pair of antibodies or populations of antibodies and given reaction conditions, a calibration curve is prepared from samples containing known concentrations of target antigen. Concentrations of the immunoreactive CD33 protein in samples being tested are then read by interpolation from the calibration curve (i.e., standard curve). Analyte can be measured either from the amount of labeled solution antibody bound at equilibrium or by kinetic measurements of bound labeled solution antibody at a series of time points before equilibrium is reached. The slope of such a curve is a measure of the concentration of the CD33 protein in a sample.

Suitable supports for use in the above methods include, e.g., nitrocellulose membranes, nylon membranes, and derivatized nylon membranes, and also particles, such as agarose, a dextran-based gel, dipsticks, particulates, microspheres, magnetic particles, test tubes, microtiter wells, SEPHADEX™ (Amersham Pharmacia Biotech, Piscataway N.J.), and the like. Immobilization can be by absorption or by covalent attachment. Optionally, anti-CD33 antibodies can be joined to a linker molecule, such as biotin for attachment to a surface bound linker, such as avidin.

In some embodiments, the present disclosure provides an anti-CD33 antibody of the present technology conjugated to a diagnostic agent. The diagnostic agent may comprise a radioactive or non-radioactive label, a contrast agent (such as for magnetic resonance imaging, computed tomography or ultrasound), and the radioactive label can be a gamma-, beta-, alpha-, Auger electron-, or positron-emitting isotope. A diagnostic agent is a molecule which is administered conjugated to an antibody moiety, i.e., antibody or antibody fragment, or subfragment, and is useful in diagnosing or detecting a disease by locating the cells containing the antigen.

Useful diagnostic agents include, but are not limited to, radioisotopes, dyes (such as with the biotin-streptavidin complex), contrast agents, fluorescent compounds or molecules and enhancing agents (e.g., paramagnetic ions) for magnetic resonance imaging (MRI). U.S. Pat. No. 6,331,175 describes MRI technique and the preparation of antibodies conjugated to a Mill enhancing agent and is incorporated in its entirety by reference. In some embodiments, the diagnostic agents are selected from the group consisting of radioisotopes, enhancing agents for use in magnetic resonance imaging, and fluorescent compounds. In order to load an antibody component with radioactive metals or paramagnetic ions, it may be necessary to react it with a reagent having a long tail to which are attached a multiplicity of chelating groups for binding the ions. Such a tail can be a polymer such as a polylysine, polysaccharide, or other derivatized or derivatizable chain having pendant groups to which can be bound chelating groups such as, e.g., ethylenediaminetetraacetic acid (EDTA), diethylenetriaminepentaacetic acid (DTPA), porphyrins, polyamines, crown ethers, bis-thiosemicarbazones, polyoximes, and like groups known to be useful for this purpose. Chelates may be coupled to the antibodies of the present technology using standard chemistries. The chelate is normally linked to the antibody by a group which enables formation of a bond to the molecule with minimal loss of immunoreactivity and minimal aggregation and/or internal cross-linking. Other methods and reagents for conjugating chelates to antibodies are disclosed in U.S. Pat. No. 4,824,659. Particularly useful metal-chelate combinations include 2-benzyl-DTPA and its monomethyl and cyclohexyl analogs, used with diagnostic isotopes for radio-imaging. The same chelates, when complexed with non-radioactive metals, such as manganese, iron and gadolinium are useful for MM, when used along with the CD33 antibodies of the present technology.

Macrocyclic chelates such as NOTA (1,4,7-triaza-cyclo-nonane-N,N',N"-triacetic acid), DOTA, and TETA (p-bromoacetamido-benzyl-tetraethylaminetetraacetic acid) are of use with a variety of metals and radiometals, such as radionuclides of gallium, yttrium and copper, respectively. Such metal-chelate complexes can be stabilized by tailoring the ring size to the metal of interest. Examples of other DOTA chelates include (i) DOTA-Phe-Lys(HSG)-D-Tyr-Lys(HSG)-NH$_2$; (ii) Ac-Lys(HSG)D-Tyr-Lys(HSG)-Lys(Tscg-Cys)-NH$_2$; (iii) DOTA-D-Asp-D-Lys(HSG)-D-Asp-D-Lys(HSG)-NH$_2$; (iv) DOTA-D-Glu-D-Lys(HSG)-D-Glu-D-Lys(HSG)-NH$_2$; (v) DOTA-D-Tyr-D-Lys(HSG)-D-Glu-D-Lys(HSG)-NH$_2$; (vi) DOTA-D-Ala-D-Lys(HSG)-D-Glu-D-Lys(HSG)-NH$_2$; (vii) DOTA-D-Phe-D-Lys(HSG)-D-Tyr-D-Lys(HSG)-NH$_2$; (viii) Ac-D-Phe-D-Lys(DOTA)-D-Tyr-D-Lys(DOTA)-NH$_2$; (ix) Ac-D-Phe-D-Lys(DTPA)-D-Tyr-D-Lys(DTPA)-NH$_2$; (x) Ac-D-Phe-D-Lys(Bz-DTPA)-D-Tyr-D-Lys(Bz-DTPA)-NH$_2$; (xi) Ac-D-Lys(HSG)-D-Tyr-D-Lys(HSG)-D-Lys(Tscg-Cys)-NH$_2$; (xii) DOTA-D-Phe-D-Lys(HSG)-D-Tyr-D-Lys(HSG)-D-Lys(Tscg-Cys)-NH$_2$; (xiii) (Tscg-Cys)-D-Phe-D-Lys(HSG)-D-Tyr-D-Lys(HSG)-D-Lys(DOTA)-NH$_2$; (xiv) Tscg-D-Cys-D-Glu-D-Lys(HSG)-D-Glu-D-Lys(HSG)-NH$_2$; (xv) (Tscg-Cys)-D-Glu-D-Lys(HSG)-D-Glu-D-Lys(HSG)-NH$_2$; (xvi) Ac-D-Cys-D-Lys(DOTA)-D-Tyr-D-Ala-D-Lys(DOTA)-D-Cys-NH$_2$; (xvii) Ac-D-Cys-D-Lys(DTPA)-D-Tyr-D-Lys(DTPA)-NH$_2$; (xviii) Ac-D-Lys(DTPA)-D-Tyr-D-Lys(DTPA)-D-Lys(Tscg-Cys)-NH$_2$; and (xix) Ac-D-Lys(DOTA)-D-Tyr-D-Lys(DOTA)-D-Lys(Tscg-Cys)-NH$_2$.

Other ring-type chelates such as macrocyclic polyethers, which are of interest for stably binding nuclides, such as $^{223}$Ra for RAIT are also contemplated.

B. Therapeutic Use of Anti-CD33 Antibodies of the Present Technology

The immunoglobulin-related compositions (e.g., antibodies or antigen binding fragments thereof) of the present technology are useful for the treatment of CD33-associated cancers and Alzheimer's disease. Such treatment can be used in patients identified as having pathologically high levels of the CD33 (e.g., those diagnosed by the methods described herein) or in patients diagnosed with a disease known to be associated with such pathological levels. In one aspect, the present disclosure provides a method for treating a CD33-associated cancer or Alzheimer's disease in a subject in need thereof, comprising administering to the subject an effective amount of an antibody (or antigen binding fragment thereof) of the present technology. Examples of cancers that can be treated by the antibodies of the present technology include, but are not limited to: AML, bi-phenotypic leukemia, bilineage leukemia, myelodysplastic syndromes, chronic myelomonocytic leukemia, myeloid blast criss of chronic myeloid leukemia, or acute lymphoblastic leukemia.

The compositions of the present technology may be employed in conjunction with other therapeutic agents useful in the treatment of CD33-associated cancers. For example, the antibodies of the present technology may be separately, sequentially or simultaneously administered with at least one additional therapeutic agent-selected from the group consisting of alkylating agents, platinum agents, taxanes, *vinca* agents, anti-estrogen drugs, aromatase inhibitors, ovarian suppression agents, VEGF/VEGFR inhibitors, EGF/EGFR inhibitors, PARP inhibitors, cytostatic alkaloids, cytotoxic antibiotics, antimetabolites, endocrine/hormonal agents, bisphosphonate therapy agents and targeted biological therapy agents (e.g., therapeutic peptides described in U.S. Pat. No. 6,306,832, WO 2012007137, WO 2005000889, WO 2010096603 etc.). In some embodiments, the at least one additional therapeutic agent is a chemotherapeutic agent. Specific chemotherapeutic agents include, but are not limited to, cyclophosphamide, fluorouracil (or 5-fluorouracil or 5-FU), methotrexate, edatrexate (10-ethyl-10-deaza-aminopterin), thiotepa, carboplatin, cisplatin, taxanes, paclitaxel, protein-bound paclitaxel, docetaxel, vinorelbine, tamoxifen, raloxifene, toremifene, fulvestrant, gemcitabine, irinotecan, ixabepilone, temozolmide, topotecan, vincristine, vinblastine, eribulin, mutamycin, capecitabine, anastrozole, exemestane, letrozole, leuprolide, abarelix, buserlin, goserelin, megestrol acetate, risedronate, pamidronate, ibandronate, alendronate, denosumab, zoledronate, trastuzumab, tykerb, anthracyclines (e.g., daunorubicin and doxorubicin), bevacizumab, oxaliplatin, melphalan, etoposide, mechlorethamine, bleomycin, microtubule poisons, annonaceous acetogenins, or combinations thereof.

The compositions of the present technology may optionally be administered as a single bolus to a subject in need thereof. Alternatively, the dosing regimen may comprise multiple administrations performed at various times after the appearance of tumors.

Methods for treating Alzheimer's disease may further comprise sequentially, separately, or simultaneously administering to the subject at least one additional therapy selected from among donepezil, galantamine, memantine, rivastigmine, memantine extended-release and donepezil (Namzaric), aducanumab, solanezumab, insulin, verubecestat, AADvac1, CSP-1103, and intepirdine.

Administration can be carried out by any suitable route, including orally, intranasally, parenterally (intravenously, intramuscularly, intraperitoneally, or subcutaneously), rectally, intracranially, intratumorally, intrathecally, or topically. Administration includes self-administration and the administration by another. It is also to be appreciated that the various modes of treatment of medical conditions as described are intended to mean "substantial", which includes total but also less than total treatment, and wherein some biologically or medically relevant result is achieved.

In some embodiments, the antibodies of the present technology comprise pharmaceutical formulations which may be administered to subjects in need thereof in one or more doses. Dosage regimens can be adjusted to provide the desired response (e.g., a therapeutic response).

Typically, an effective amount of the antibody compositions of the present technology, sufficient for achieving a therapeutic effect, range from about 0.000001 mg per kilogram body weight per day to about 10,000 mg per kilogram body weight per day. Typically, the dosage ranges are from about 0.0001 mg per kilogram body weight per day to about 100 mg per kilogram body weight per day. For administration of anti-CD33 antibodies, the dosage ranges from about 0.0001 to 100 mg/kg, and more usually 0.01 to 5 mg/kg every week, every two weeks or every three weeks, of the subject body weight. For example, dosages can be 1 mg/kg body weight or 10 mg/kg body weight every week, every two weeks or every three weeks or within the range of 1-10 mg/kg every week, every two weeks or every three weeks. In one embodiment, a single dosage of antibody ranges from 0.1-10,000 micrograms per kg body weight. In one embodiment, antibody concentrations in a carrier range from 0.2 to 2000 micrograms per delivered milliliter. An exemplary treatment regime entails administration once per every two weeks or once a month or once every 3 to 6 months. Anti-CD33 antibodies may be administered on multiple occasions. Intervals between single dosages can be hourly, daily, weekly, monthly or yearly. Intervals can also be irregular as indicated by measuring blood levels of the antibody in the subject. In some methods, dosage is adjusted to achieve a serum antibody concentration in the subject of from about 75 µg/mL to about 125 µg/mL, 100 µg/mL to about 150 µg/mL, from about 125 µg/mL to about 175 µg/mL, or from about 150 µg/mL to about 200 µg/mL. Alternatively, anti-CD33 antibodies can be administered as a sustained release formulation, in which case less frequent administration is required. Dosage and frequency vary depending on the half-life of the antibody in the subject. The dosage and frequency of administration can vary depending on whether the treatment is prophylactic or therapeutic. In prophylactic applications, a relatively low dosage is administered at relatively infrequent intervals over a long period of time. In therapeutic applications, a relatively high dosage at relatively short intervals is sometimes required until progression of the disease is reduced or terminated, or until the subject shows partial or complete amelioration of symptoms of disease. Thereafter, the patient can be administered a prophylactic regime.

In another aspect, the present disclosure provides a method for detecting a tumor in a subject in vivo comprising (a) administering to the subject an effective amount of an antibody (or antigen binding fragment thereof) of the present technology, wherein the antibody is configured to localize to a tumor expressing CD33 and is labeled with a radioisotope; and (b) detecting the presence of a tumor in the subject by detecting radioactive levels emitted by the antibody that are higher than a reference value. In some embodiments, the reference value is expressed as injected dose per gram (% ID/g). The reference value may be calculated by measuring the radioactive levels present in non-tumor (normal) tissues, and computing the average radioactive levels present in non-tumor (normal) tissues±standard deviation. In some embodiments, the ratio of radioactive levels between a tumor and normal tissue is about 2:1, 3:1, 4:1, 5:1, 6:1, 7:1, 8:1, 9:1, 10:1, 15:1, 20:1, 25:1, 30:1, 35:1, 40:1, 45:1, 50:1, 55:1, 60:1, 65:1, 70:1, 75:1, 80:1, 85:1, 90:1, 95:1 or 100:1.

In some embodiments, the subject is diagnosed with or is suspected of having cancer. Radioactive levels emitted by the antibody may be detected using positron emission tomography or single photon emission computed tomography.

Additionally or alternatively, in some embodiments, the method further comprises administering to the subject an effective amount of an immunoconjugate comprising an antibody of the present technology conjugated to a radionuclide. In some embodiments, the radionuclide is an alpha particle-emitting isotope, a beta particle-emitting isotope, an Auger-emitter, or any combination thereof. Examples of beta particle-emitting isotopes include $^{86}$Y, $^{90}$Y, $^{89}$Sr, $^{165}$Dy, $^{186}$Re, $^{188}$Re, $^{177}$Lu, and $^{67}$Cu. Examples of alpha particle-emitting isotopes include $^{213}$Bi, $^{211}$At, $^{225}$Ac, $^{152}$Dy, $^{212}$Bi, $^{223}$Ra, $^{219}$Rn, $^{215}$Po, $^{211}$Bi, $^{221}$Fr, $^{217}$At, and $^{255}$Fm. Examples of Auger-emitters include $^{111}$In, $^{67}$Ga, $^{51}$Cr, $^{58}$Co, $^{99m}$Tc, $^{103m}$Rh, $^{195m}$Pt, $^{119}$Sb, $^{161}$Ho, $^{189m}$Os, $^{192}$Ir, $^{201}$Tl, and $^{203}$Pb. In some embodiments of the method, nonspecific FcR-dependent binding in normal tissues is eliminated or reduced (e.g., via N297A mutation in Fc region, which results in aglycosylation). The therapeutic effectiveness of such an immunoconjugate may be determined by computing the area under the curve (AUC) tumor: AUC normal tissue ratio. In some embodiments, the immunoconjugate has a AUC tumor: AUC normal tissue ratio of about 2:1, 3:1, 4:1, 5:1, 6:1, 7:1, 8:1, 9:1, 10:1, 15:1, 20:1, 25:1, 30:1, 35:1, 40:1, 45:1, 50:1, 55:1, 60:1, 65:1, 70:1, 75:1, 80:1, 85:1, 90:1, 95:1 or 100:1.

PRIT. In one aspect, the present disclosure provides a method for detecting tumors in a subject in need thereof comprising (a) administering to the subject an effective amount of a complex comprising a radiolabeled DOTA hapten and a bispecific antibody of the present technology that binds to the radiolabeled DOTA hapten and a CD33 antigen, wherein the complex is configured to localize to a tumor expressing the CD33 antigen recognized by the bispecific antibody of the complex; and (b) detecting the presence of solid tumors in the subject by detecting radioactive levels emitted by the complex that are higher than a reference value. In some embodiments, the subject is human.

In another aspect, the present disclosure provides a method for selecting a subject for pretargeted radioimmunotherapy comprising (a) administering to the subject an effective amount of a complex comprising a radiolabeled DOTA hapten and a bispecific antibody of the present technology that binds to the radiolabeled DOTA hapten and a CD33 antigen, wherein the complex is configured to localize to a tumor expressing the CD33 antigen recognized by the bispecific antibody of the complex; (b) detecting radioactive levels emitted by the complex; and (c) selecting the subject for pretargeted radioimmunotherapy when the radioactive levels emitted by the complex are higher than a reference value. In some embodiments, the subject is human.

Examples of DOTA haptens include (i) DOTA-Phe-Lys(HSG)-D-Tyr-Lys(HSG)-NH$_2$; (ii) Ac-Lys(HSG)D-Tyr-Lys(HSG)-Lys(Tscg-Cys)-NH$_2$; (iii) DOTA-D-Asp-D-Lys(HSG)-D-Asp-D-Lys(HSG)-NH$_2$; (iv) DOTA-D-Glu-D-Lys(HSG)-D-Glu-D-Lys(HSG)-NH$_2$; (v) DOTA-D-Tyr-D-Lys(HSG)-D-Glu-D-Lys(HSG)-NH$_2$; (vi) DOTA-D-Ala-D-Lys(HSG)-D-Glu-D-Lys(HSG)-NH$_2$; (vii) DOTA-D-Phe-D-Lys(HSG)-D-Tyr-D-Lys(HSG)-NH$_2$; (viii) Ac-D-Phe-D-Lys(DOTA)-D-Tyr-D-Lys(DOTA)-NH$_2$; (ix) Ac-D-Phe-D-Lys(DTPA)-D-Tyr-D-Lys(DTPA)-NH$_2$; (x) Ac-D-Phe-D-Lys(Bz-DTPA)-D-Tyr-D-Lys(Bz-DTPA)-NH$_2$; (xi) Ac-D-

Lys(HSG)-D-Tyr-D-Lys(HSG)-D-Lys(Tscg-Cys)-NH$_2$; (xii) DOTA-D-Phe-D-Lys(HSG)-D-Tyr-D-Lys(HSG)-D-Lys (Tscg-Cys)-NH$_2$; (xiii) (Tscg-Cys)-D-Phe-D-Lys(HSG)-D-Tyr-D-Lys(HSG)-D-Lys(DOTA)-NH$_2$; (xiv) Tscg-Cys-D-Glu-D-Lys(HSG)-D-Glu-D-Lys(HSG)-NH$_2$; (xv) (Tscg-Cys)-D-Glu-D-Lys(HSG)-D-Glu-D-Lys(HSG)-NH$_2$; (xvi) Ac-D-Cys-D-Lys(DOTA)-D-Tyr-D-Ala-D-Lys(DOTA)-D-Cys-NH$_2$; (xvii) Ac-D-Cys-D-Lys(DTPA)-D-Tyr-D-Lys(DTPA)-NH$_2$; (xviii) Ac-D-Lys(DTPA)-D-Tyr-D-Lys(DTPA)-D-Lys(Tscg-Cys)-NH$_2$; (xix) Ac-D-Lys(DOTA)-D-Tyr-D-Lys(DOTA)-D-Lys(Tscg-Cys)-NH$_2$ and (xx) DOTA. The radiolabel may be an alpha particle-emitting isotope, a beta particle-emitting isotope, or an Auger-emitter. Examples of radiolabels include $^{213}$Bi, $^{211}$At, $^{225}$Ac, $^{152}$Dy, $^{212}$Bi, $^{223}$Ra, $^{219}$Rn, $^{215}$Po, $^{211}$Bi, $^{221}$Fr, $^{217}$At, $^{255}$Fm, $^{86}$Y, $^{90}$Y, $^{89}$Sr, $^{165}$Dy, $^{186}$Re, $^{188}$Re, $^{177}$Lu, $^{67}$Cu, $^{111}$In, $^{67}$Ga, $^{51}$Cr, $^{58}$CO, $^{99m}$TC, $^{103m}$Rh, $^{195m}$Pt, $^{119}$Sb, $^{161}$Ho, $^{189m}$Os, $^{192}$Ir, $^{201}$Tl, $^{203}$Pb, $^{68}$Ga, $^{227}$Th, or $^{64}$Cu.

In some embodiments of the methods disclosed herein, the radioactive levels emitted by the complex are detected using positron emission tomography or single photon emission computed tomography. Additionally or alternatively, in some embodiments of the methods disclosed herein, the subject is diagnosed with, or is suspected of having Alzheimer's disease or a CD33 associated cancer such as AML, bi-phenotypic leukemia, bilineage leukemia, myelodysplastic syndromes, chronic myelomonocytic leukemia, myeloid blast criss of chronic myeloid leukemia, or acute lymphoblastic leukemia.

Additionally or alternatively, in some embodiments of the methods disclosed herein, the complex is administered intravenously, intramuscularly, intraarterially, intrathecally, intracapsularly, intraorbitally, intradermally, intraperitoneally, transtracheally, subcutaneously, intracerebroventricularly, orally, intratumorally, or intranasally. In certain embodiments, the complex is administered into the cerebral spinal fluid or blood of the subject.

In some embodiments of the methods disclosed herein, the radioactive levels emitted by the complex are detected between 2 to 120 hours after the complex is administered. In certain embodiments of the methods disclosed herein, the radioactive levels emitted by the complex are expressed as the percentage injected dose per gram tissue (% ID/g). The reference value may be calculated by measuring the radioactive levels present in non-tumor (normal) tissues, and computing the average radioactive levels present in non-tumor (normal) tissues±standard deviation. In some embodiments, the reference value is the standard uptake value (SUV). See Thie J A, *J Nucl Med.* 45(9):1431-4 (2004). In some embodiments, the ratio of radioactive levels between a tumor and normal tissue is about 2:1, 3:1, 4:1, 5:1, 6:1, 7:1, 8:1, 9:1, 10:1, 15:1, 20:1, 25:1, 30:1, 35:1, 40:1, 45:1, 50:1, 55:1, 60:1, 65:1, 70:1, 75:1, 80:1, 85:1, 90:1, 95:1 or 100:1.

In another aspect, the present disclosure provides a method for increasing tumor sensitivity to radiation therapy in a subject diagnosed with a CD33-associated cancer comprising (a) administering an effective amount of an anti-DOTA bispecific antibody of the present technology to the subject, wherein the anti-DOTA bispecific antibody is configured to localize to a tumor expressing a CD33 antigen target; and (b) administering an effective amount of a radiolabeled-DOTA hapten to the subject, wherein the radiolabeled-DOTA hapten is configured to bind to the anti-DOTA bispecific antibody. In some embodiments, the subject is human.

The anti-DOTA bispecific antibody is administered under conditions and for a period of time (e.g., according to a dosing regimen) sufficient for it to saturate tumor cells. In some embodiments, unbound anti-DOTA bispecific antibody is removed from the blood stream after administration of the anti-DOTA bispecific antibody. In some embodiments, the radiolabeled-DOTA hapten is administered after a time period that may be sufficient to permit clearance of unbound anti-DOTA bispecific antibody.

The radiolabeled-DOTA hapten may be administered at any time between 1 minute to 4 or more days following administration of the anti-DOTA bispecific antibody. For example, in some embodiments, the radiolabeled-DOTA hapten is administered 1 minute, 2 minutes, 3 minutes, 4 minutes, 5 minutes, 10 minutes, 15 minutes, 20 minutes, 25 minutes, 30 minutes, 35 minutes, 40 minutes, 45 minutes, 50 minutes, 55 minutes, 1 hour, 1.25 hours, 1.5 hours, 1.75 hours, 2 hours, 2.5 hours, 3 hours, 3.5 hours, 4 hours, 4.5 hours, 5 hours, 5.5 hours, 6 hours, 6.5 hours, 7 hours, 7.5 hours, 8 hours, 8.5 hours, 9 hours, 9.5 hours, 10 hours, 11 hours, 12 hours, 13 hours, 14 hours, 15 hours, 16 hours, 17 hours, 18 hours, 19 hours, 20 hours, 21 hours, 22 hours, 23 hours, 24 hours, 48 hours, 72 hours, 96 hours, or any range therein, following administration of the anti-DOTA bispecific antibody. Alternatively, the radiolabeled-DOTA hapten may be administered at any time after 4 or more days following administration of the anti-DOTA bispecific antibody.

Additionally or alternatively, in some embodiments, the method further comprises administering an effective amount of a clearing agent to the subject prior to administration of the radiolabeled-DOTA hapten. A clearing agent can be any molecule (dextran or dendrimer or polymer) that can be conjugated with C825-hapten. In some embodiments, the clearing agent is no more than 2000 kD, 1500 kD, 1000 kD, 900 kD, 800 kD, 700 kD, 600 kD, 500 kD, 400 kD, 300 kD, 200 kD, 100 kD, 90 kD, 80 kD, 70 kD, 60 kD, 50 kD, 40 kD, 30 kD, 20 kD, 10 kD, or 5 kD. In some embodiments, the clearing agent is a 500 kD aminodextran-DOTA conjugate (e.g., 500 kD dextran-DOTA-Bn (Y), 500 kD dextran-DOTA-Bn (Lu), or 500 kD dextran-DOTA-Bn (In) etc.).

In some embodiments, the clearing agent and the radiolabeled-DOTA hapten are administered without further administration of the anti-DOTA bispecific antibody of the present technology. For example, in some embodiments, an anti-DOTA bispecific antibody of the present technology is administered according to a regimen that includes at least one cycle of: (i) administration of the anti-DOTA bispecific antibody of the present technology (optionally so that relevant tumor cells are saturated); (ii) administration of a radiolabeled-DOTA hapten and, optionally a clearing agent; (iii) optional additional administration of the radiolabeled-DOTA hapten and/or the clearing agent, without additional administration of the anti-DOTA bispecific antibody. In some embodiments, the method may comprise multiple such cycles (e.g., 1, 2, 3, 4, 5, 6, 7, 8, 9, 10 or more cycles).

Additionally or alternatively, in some embodiments of the method, the anti-DOTA bispecific antibody and/or the radiolabeled-DOTA hapten is administered intravenously, intramuscularly, intraarterially, intrathecally, intracapsularly, intraorbitally, intradermally, intraperitoneally, transtracheally, subcutaneously, intracerebroventricularly, intratumorally, orally or intranasally.

In one aspect, the present disclosure provides a method for increasing tumor sensitivity to radiation therapy in a subject diagnosed with a CD33-associated cancer comprising administering to the subject an effective amount of a complex comprising a radiolabeled-DOTA hapten and a bispecific antibody of the present technology that recognizes and binds to the radiolabeled-DOTA hapten and a CD33 antigen target, wherein the complex is configured to localize to a tumor expressing the CD33 antigen target recognized by the bispecific antibody of the complex. The complex may be administered intravenously, intramuscularly, intraarterially, intrathecally, intracapsularly, intraorbitally, intradermally, intraperitoneally, transtracheally, subcutaneously, intracerebroventricularly, orally, intratumorally, or intranasally. In some embodiments, the subject is human.

In another aspect, the present disclosure provides a method for treating cancer in a subject in need thereof comprising (a) administering an effective amount of an anti-DOTA bispecific antibody of the present technology to the subject, wherein the anti-DOTA bispecific antibody is configured to localize to a tumor expressing a CD33 antigen target; and (b) administering an effective amount of a radiolabeled-DOTA hapten to the subject, wherein the radiolabeled-DOTA hapten is configured to bind to the anti-DOTA bispecific antibody. The anti-DOTA bispecific antibody is administered under conditions and for a period of time (e.g., according to a dosing regimen) sufficient for it to saturate tumor cells. In some embodiments, unbound anti-DOTA bispecific antibody is removed from the blood stream after administration of the anti-DOTA bispecific antibody. In some embodiments, the radiolabeled-DOTA hapten is administered after a time period that may be sufficient to permit clearance of unbound anti-DOTA bispecific antibody. In some embodiments, the subject is human.

Accordingly, in some embodiments, the method further comprises administering an effective amount of a clearing agent to the subject prior to administration of the radiolabeled-DOTA hapten. The radiolabeled-DOTA hapten may be administered at any time between 1 minute to 4 or more days following administration of the anti-DOTA bispecific antibody. For example, in some embodiments, the radiolabeled-DOTA hapten is administered 1 minute, 2 minutes, 3 minutes, 4 minutes, 5 minutes, 10 minutes, 15 minutes, 20 minutes, 25 minutes, 30 minutes, 35 minutes, 40 minutes, 45 minutes, 50 minutes, 55 minutes, 1 hour, 1.25 hours, 1.5 hours, 1.75 hours, 2 hours, 2.5 hours, 3 hours, 3.5 hours, 4 hours, 4.5 hours, 5 hours, 5.5 hours, 6 hours, 6.5 hours, 7 hours, 7.5 hours, 8 hours, 8.5 hours, 9 hours, 9.5 hours, 10 hours, 11 hours, 12 hours, 13 hours, 14 hours, 15 hours, 16 hours, 17 hours, 18 hours, 19 hours, 20 hours, 21 hours, 22 hours, 23 hours, 24 hours, 48 hours, 72 hours, 96 hours, or any range therein, following administration of the anti-DOTA bispecific antibody. Alternatively, the radiolabeled-DOTA hapten may be administered at any time after 4 or more days following administration of the anti-DOTA bispecific antibody.

The clearing agent may be a 500 kD aminodextran-DOTA conjugate (e.g., 500 kD dextran-DOTA-Bn (Y), 500 kD dextran-DOTA-Bn (Lu), or 500 kD dextran-DOTA-Bn (In) etc.). In some embodiments, the clearing agent and the radiolabeled-DOTA hapten are administered without further administration of the anti-DOTA bispecific antibody. For example, in some embodiments, an anti-DOTA bispecific antibody is administered according to a regimen that includes at least one cycle of: (i) administration of the an anti-DOTA bispecific antibody of the present technology (optionally so that relevant tumor cells are saturated); (ii) administration of a radiolabeled-DOTA hapten and, optionally a clearing agent; (iii) optional additional administration of the radiolabeled-DOTA hapten and/or the clearing agent, without additional administration of the anti-DOTA bispecific antibody. In some embodiments, the method may comprise multiple such cycles (e.g., 1, 2, 3, 4, 5, 6, 7, 8, 9, 10 or more cycles).

Also provided herein are methods for treating cancer in a subject in need thereof comprising administering to the subject an effective amount of a complex comprising a radiolabeled-DOTA hapten and a bispecific antibody of the present technology that recognizes and binds to the radiolabeled-DOTA hapten and a CD33 antigen target, wherein the complex is configured to localize to a tumor expressing the CD33 antigen target recognized by the bispecific antibody of the complex. The therapeutic effectiveness of such a complex may be determined by computing the area under the curve (AUC) tumor: AUC normal tissue ratio. In some embodiments, the complex has a AUC tumor: AUC normal tissue ratio of about 2:1, 3:1, 4:1, 5:1, 6:1, 7:1, 8:1, 9:1, 10:1, 15:1, 20:1, 25:1, 30:1, 35:1, 40:1, 45:1, 50:1, 55:1, 60:1, 65:1, 70:1, 75:1, 80:1, 85:1, 90:1, 95:1 or 100:1.

Toxicity. Optimally, an effective amount (e.g., dose) of an anti-CD33 antibody described herein will provide therapeutic benefit without causing substantial toxicity to the subject. Toxicity of the anti-CD33 antibody described herein can be determined by standard pharmaceutical procedures in cell cultures or experimental animals, e.g., by determining the $LD_{50}$ (the dose lethal to 50% of the population) or the $LD_{100}$ (the dose lethal to 100% of the population). The dose ratio between toxic and therapeutic effect is the therapeutic index. The data obtained from these cell culture assays and animal studies can be used in formulating a dosage range that is not toxic for use in human. The dosage of the anti-CD33 antibody described herein lies within a range of circulating concentrations that include the effective dose with little or no toxicity. The dosage can vary within this range depending upon the dosage form employed and the route of administration utilized. The exact formulation, route of administration and dosage can be chosen by the individual physician in view of the subject's condition. See, e.g., Fingl et al., In: *The Pharmacological Basis of Therapeutics*, Ch. 1 (1975).

Formulations of Pharmaceutical Compositions. According to the methods of the present technology, the anti-CD33 antibody can be incorporated into pharmaceutical compositions suitable for administration. The pharmaceutical compositions generally comprise recombinant or substantially purified antibody and a pharmaceutically-acceptable carrier in a form suitable for administration to a subject. Pharmaceutically-acceptable carriers are determined in part by the particular composition being administered, as well as by the particular method used to administer the composition. Accordingly, there is a wide variety of suitable formulations of pharmaceutical compositions for administering the antibody compositions (See, e.g., *Remington's Pharmaceutical Sciences*, Mack Publishing Co., Easton, Pa. $18^{th}$ ed 1990). The pharmaceutical compositions are generally formulated as sterile, substantially isotonic and in full compliance with all Good Manufacturing Practice (GMP) regulations of the U.S. Food and Drug Administration.

The terms "pharmaceutically-acceptable," "physiologically-tolerable," and grammatical variations thereof, as they refer to compositions, carriers, diluents and reagents, are used interchangeably and represent that the materials are capable of administration to or upon a subject without the production of undesirable physiological effects to a degree that would prohibit administration of the composition. For example, "pharmaceutically-acceptable excipient" means an excipient that is useful in preparing a pharmaceutical composition that is generally safe, non-toxic, and desirable, and includes excipients that are acceptable for veterinary use as well as for human pharmaceutical use. Such excipients can be solid, liquid, semisolid, or, in the case of an aerosol composition, gaseous. "Pharmaceutically-acceptable salts and esters" means salts and esters that are pharmaceutically-acceptable and have the desired pharmacological properties. Such salts include salts that can be formed where acidic protons present in the composition are capable of reacting with inorganic or organic bases. Suitable inorganic salts include those formed with the alkali metals, e.g., sodium and potassium, magnesium, calcium, and aluminum. Suitable organic salts include those formed with organic bases such as the amine bases, e.g., ethanolamine, diethanolamine, triethanolamine, tromethamine, N-methylglucamine, and the like. Such salts also include acid addition salts formed with inorganic acids (e.g., hydrochloric and hydrobromic acids) and organic acids (e.g., acetic acid, citric acid, maleic acid, and the alkane- and arene-sulfonic acids such as methanesulfonic acid and benzenesulfonic acid). Pharmaceutically-acceptable esters include esters formed from carboxy, sulfonyloxy, and phosphonoxy groups present in the anti-CD33 antibody, e.g., C1-6 alkyl esters. When there are two acidic groups present, a pharmaceutically-acceptable salt or ester can be a mono-acid-mono-salt or ester or a di-salt or ester; and similarly where there are more than two acidic groups present, some or all of such groups can be salified or esterified. An anti-CD33 antibody named in this technology can be present in unsalified or unesterified form, or in salified and/or esterified form, and the naming of such anti-CD33 antibody is intended to include both the original (unsalified and unesterified) compound and its pharmaceutically-acceptable salts and esters. Also, certain embodiments of the present technology can be present in more than one stereoisomeric form, and the naming of such anti-CD33 antibody is intended to include all single stereoisomers and all mixtures (whether racemic or otherwise) of such stereoisomers. A person of ordinary skill in the art, would have no difficulty determining the appropriate timing, sequence and dosages of administration for particular drugs and compositions of the present technology.

Examples of such carriers or diluents include, but are not limited to, water, saline, Ringer's solutions, dextrose solution, and 5% human serum albumin. Liposomes and non-aqueous vehicles such as fixed oils may also be used. The use of such media and compounds for pharmaceutically active substances is well known in the art. Except insofar as any conventional media or compound is incompatible with the anti-CD33 antibody, use thereof in the compositions is contemplated. Supplementary active compounds can also be incorporated into the compositions.

A pharmaceutical composition of the present technology is formulated to be compatible with its intended route of administration. The anti-CD33 antibody compositions of the present technology can be administered by parenteral, topical, intravenous, oral, subcutaneous, intraarterial, intradermal, transdermal, rectal, intracranial, intrathecal, intraperitoneal, intranasal; or intramuscular routes, or as inhalants. The anti-CD33 antibody can optionally be administered in combination with other agents that are at least partly effective in treating various CD33-associated cancers or Alzheimer's Disease.

Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial compounds such as benzyl alcohol or methyl parabens; antioxidants such as ascorbic acid or sodium bisulfite; chelating compounds such as ethylenediaminetetraacetic acid (EDTA); buffers such as acetates, citrates or phosphates, and compounds for the adjustment of tonicity such as sodium chloride or dextrose. The pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringeability exists. It must be stable under the conditions of manufacture and storage and must be preserved against the contaminating action of microorganisms such as bacteria and fungi. The carrier can be a solvent or dispersion medium containing, e.g., water, ethanol, polyol (e.g., glycerol, propylene glycol, and liquid polyethylene glycol, and the like), and suitable mixtures thereof. The proper fluidity can be maintained, e.g., by the use of a coating such as lecithin, by the maintenance of the required particle size in the case of dispersion and by the use of surfactants. Prevention of the action of microorganisms can be achieved by various antibacterial and antifungal compounds, e.g., parabens, chlorobutanol, phenol, ascorbic acid, thimerosal, and the like. In many cases, it will be desirable to include isotonic compounds, e.g., sugars, polyalcohols such as manitol, sorbitol, sodium chloride in the composition. Prolonged absorption of the injectable compositions can be brought about by including in the composition a compound which delays absorption, e.g., aluminum monostearate and gelatin.

Sterile injectable solutions can be prepared by incorporating an anti-CD33 antibody of the present technology in the required amount in an appropriate solvent with one or a combination of ingredients enumerated above, as required, followed by filtered sterilization. Generally, dispersions are prepared by incorporating the anti-CD33 antibody into a sterile vehicle that contains a basic dispersion medium and the required other ingredients from those enumerated above. In the case of sterile powders for the preparation of sterile injectable solutions, methods of preparation are vacuum drying and freeze-drying that yields a powder of the active ingredient plus any additional desired ingredient from a previously sterile-filtered solution thereof. The antibodies of the present technology can be administered in the form of a depot injection or implant preparation which can be formulated in such a manner as to permit a sustained or pulsatile release of the active ingredient.

Oral compositions generally include an inert diluent or an edible carrier. They can be enclosed in gelatin capsules or compressed into tablets. For the purpose of oral therapeutic administration, the anti-CD33 antibody can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding compounds, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating compound such as alginic acid, Primogel, or corn starch; a lubricant such as magnesium stearate or Sterotes; a glidant such as colloidal silicon dioxide; a sweetening compound such as sucrose or saccharin; or a flavoring compound such as peppermint, methyl salicylate, or orange flavoring.

For administration by inhalation, the anti-CD33 antibody is delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, e.g., for transmucosal administration, detergents, bile salts, and fusidic acid derivatives. Transmucosal administration can be accomplished through the use of nasal sprays or suppositories. For transdermal administration, the anti-CD33 antibody is formulated into ointments, salves, gels, or creams as generally known in the art.

The anti-CD33 antibody can also be prepared as pharmaceutical compositions in the form of suppositories (e.g., with conventional suppository bases such as cocoa butter and other glycerides) or retention enemas for rectal delivery.

In one embodiment, the anti-CD33 antibody is prepared with carriers that will protect the anti-CD33 antibody against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically-acceptable carriers. These can be prepared according to methods known to those skilled in the art, e.g., as described in U.S. Pat. No. 4,522,811.

C. Kits

The present technology provides kits for the detection and/or treatment of CD33-associated cancers or Alzheimer's disease, comprising at least one immunoglobulin-related composition of the present technology (e.g., any antibody or antigen binding fragment described herein), or a functional variant (e.g., substitutional variant) thereof. Optionally, the above described components of the kits of the present technology are packed in suitable containers and labeled for diagnosis and/or treatment of CD33-associated cancers or Alzheimer's disease. The above-mentioned components may be stored in unit or multi-dose containers, for example, sealed ampoules, vials, bottles, syringes, and test tubes, as an aqueous, preferably sterile, solution or as a lyophilized, preferably sterile, formulation for reconstitution. The kit may further comprise a second container which holds a diluent suitable for diluting the pharmaceutical composition towards a higher volume. Suitable diluents include, but are not limited to, the pharmaceutically acceptable excipient of the pharmaceutical composition and a saline solution. Furthermore, the kit may comprise instructions for diluting the pharmaceutical composition and/or instructions for administering the pharmaceutical composition, whether diluted or not. The containers may be formed from a variety of materials such as glass or plastic and may have a sterile access port (for example, the container may be an intravenous solution bag or a vial having a stopper which may be pierced by a hypodermic injection needle). The kit may further comprise more containers comprising a pharmaceutically acceptable buffer, such as phosphate-buffered saline, Ringer's solution and dextrose solution. It may further include other materials desirable from a commercial and user standpoint, including other buffers, diluents, filters, needles, syringes, culture medium for one or more of the suitable hosts. The kits may optionally include instructions customarily included in commercial packages of therapeutic or diagnostic products, that contain information about, for example, the indications, usage, dosage, manufacture, administration, contraindications and/or warnings concerning the use of such therapeutic or diagnostic products.

The kits are useful for detecting the presence of an immunoreactive CD33 protein in a biological sample, e.g., any body fluid including, but not limited to, e.g., serum, plasma, lymph, cystic fluid, urine, stool, cerebrospinal fluid, ascitic fluid or blood and including biopsy samples of body tissue. For example, the kit can comprise: one or more humanized, chimeric, or bispecific anti-CD33 antibodies of the present technology (or antigen binding fragments thereof) capable of binding a CD33 protein in a biological sample; means for determining the amount of the CD33 protein in the sample; and means for comparing the amount of the immunoreactive CD33 protein in the sample with a standard. One or more of the anti-CD33 antibodies may be labeled. The kit components, (e.g., reagents) can be packaged in a suitable container. The kit can further comprise instructions for using the kit to detect the immunoreactive CD33 protein.

For antibody-based kits, the kit can comprise, e.g., 1) a first antibody, e.g. a humanized, chimeric or bispecific CD33 antibody of the present technology (or an antigen binding fragment thereof), attached to a solid support, which binds to a CD33 protein; and, optionally; 2) a second, different antibody which binds to either the CD33 protein or to the first antibody, and is conjugated to a detectable label.

The kit can also comprise, e.g., a buffering agent, a preservative or a protein-stabilizing agent. The kit can further comprise components necessary for detecting the detectable-label, e.g., an enzyme or a substrate. The kit can also contain a control sample or a series of control samples, which can be assayed and compared to the test sample. Each component of the kit can be enclosed within an individual container and all of the various containers can be within a single package, along with instructions for interpreting the results of the assays performed using the kit. The kits of the present technology may contain a written product on or in the kit container. The written product describes how to use the reagents contained in the kit, e.g., for detection of a CD33 protein in vitro or in vivo, or for treatment of CD33-associated cancers in a subject in need thereof. In certain embodiments, the use of the reagents can be according to the methods of the present technology.

EXAMPLES

The present technology is further illustrated by the following Examples, which should not be construed as limiting in any way. The following Examples demonstrate the preparation, characterization, and use of illustrative anti-CD33 antibodies of the present technology. The following Examples demonstrate the production of chimeric, humanized, and bispecific antibodies of the present technology, and characterization of their binding specificities and in vitro and in vivo biological activities.

Example 1: Structure and Binding Affinity of the Chimeric and Humanized Anti-CD33 Antibodies of the Present Disclosure Humanization of murine HIM34. The CDRs of the heavy and light chains of HIM34 were grafted onto human IgG1 frameworks based on their homology with human frameworks IGHV1-2*02 IGHJ4*01 for VH, IGKV1-33*01-IGKJ2*01 for VL, respectively. From six heavy chain and five light chain designs, 30 versions of huHIM34 were gene synthesized and expressed in DG44 cells. The amino acid sequences of the murine, chimeric, and humanized HIM34 variable heavy chains are shown in SEQ ID NOs. 2-7 and 114 and FIG. 8 and FIG. 10(B). The amino acid sequences of the muringe, chimeric, and humanized HIM34 variable light chains are shown in SEQ ID NOs. 9-13 and 115 and FIG. 9 and FIG. 10(A).

Figure 3:
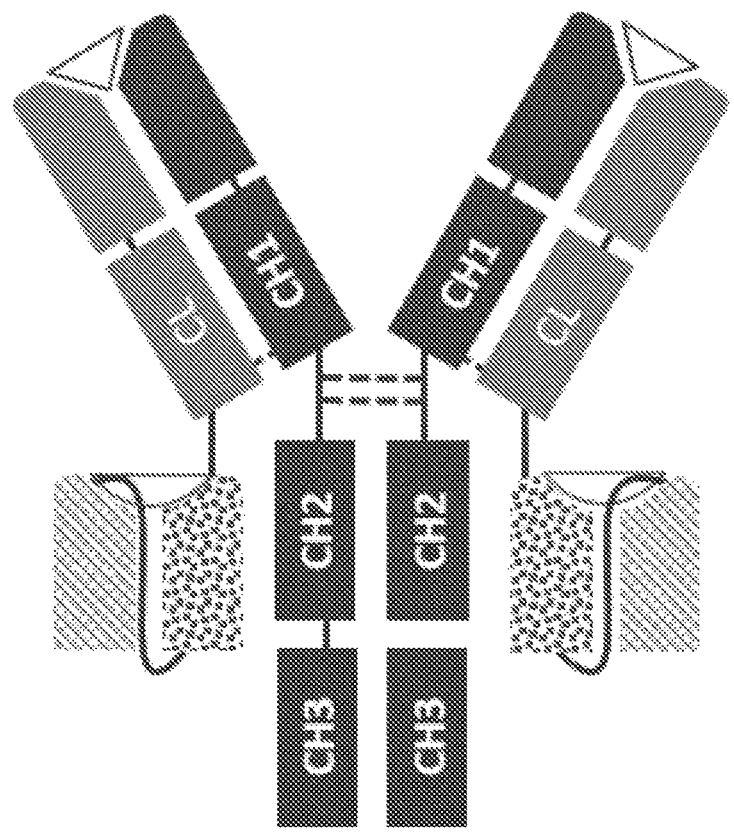
FIG. 3 shows a schematic of the modular tetravalent IgG-scFv format comprising an IgG molecule with two binding sites covalently linked to two scFvs providing two additional binding domains.

Generation of CD33-BsAb bispecific antibodies. CD33-BsAbs were designed using the IgG-scFv format (FIG. 3). CD33-BsAbs were constructed by fusing the humanized OKT3 scFv onto the C-terminus of the light chain of the chimeric or humanized anti-CD33 antibody via a $(G_4S)_3$ linker (SEQ ID NO: 164) as previously described in Xu H et al., *Cancer Immunology Research* 3:266-277 (2015) and Lopez-Albaitero A et al., *OncoImmunology* 6:e1267891 (2017). N297A and K322A mutations were introduced in the Fc region of the antibody to eliminate FcR and complement binding activities, respectively (Shields R L et al., *Journal of Biological Chemistry* 276:6591-6604 (2001); Idusogie E E et al., *Journal of Immunology* 164:4178-4184 (2000)). The DNA construct was then transfected into CHO-S cells and stable clones were selected for high levels of antibody production. For larger-scale antibody purification, the selected stable clone was expanded in shaker flasks. The bispecific antibody was purified from supernatant using one-step protein A affinity chromatography.

FIG. 10 shows the amino acid sequences of the light chain and heavy chain of the chimeric CD33-BsAb (chHIM34-BsAb), which correspond to SEQ ID NO: 14 and SEQ ID NO: 16 respectively. FIGS. 11(A)-11(B), FIGS. 11(C)-11(D), FIGS. 12(A)-12(B), and FIGS. 13(A)-13(B) show the amino acid sequences of the light chain and heavy chain of four humanized CD33-BsAbs (hHIM34-BsAbs): BC249, BC275, BC267, and BC268, respectively. FIGS. 11(A)-11(B) show the amino acid sequences of the light chain and heavy chain of BC249, which correspond to SEQ ID NO: 18 and SEQ ID NO: 20, respectively, and which are based on the humanized HIM34 variable light chain VL-3 and variable heavy chain VH-5. FIGS. 11(C)-11(D) show the amino acid sequences of the light chain and heavy chain of BC275, which correspond to SEQ ID NO: 134 and SEQ ID NO: 136, respectively, and which are based on the humanized HIM34 variable light chain VL-4 and variable heavy chain VH-5.

FIGS. 12(A)-12(B) show the amino acid sequences of the light chain and heavy chain of BC267, which correspond to SEQ ID NO: 18 and SEQ ID NO: 22, respectively, and which are based on the humanized HIM34 variable light chain VL-3 and variable heavy chain VH-6. FIGS. 13(A)-13(B) show the amino acid sequences of the light chain and heavy chain of BC268, which correspond to SEQ ID NO: 24 and SEQ ID NO: 22, respectively, and which are based on the humanized HIM34 variable light chain VL-4 and variable heavy chain VH-6.

Comparative binding kinetics of chimeric and humanized forms of anti-CD33 antibodies by surface plasmon resonance. To determine whether humanized anti-CD33 HIM34 antibodies bind to CD33 with equal affinity as the chimeric form, surface plasmon resonance assay using Biacore T-200 was performed. Biacore T-200 Biosensor, CM5 sensor chip, and related reagents were purchased from GE Healthcare. CD33 as the active surfaces and blank as the reference were immobilized onto the CM5 sensor chip at around 1000 RU (response units) using the Amino Coupling kit (GE Healthcare). CD33 antibodies and relevant control antibodies were diluted in HBS-EP buffer (0.01 M HEPES pH 7.4, 0.15 M NaCl, 3 mM EDTA, 0.05% v/v Surfactant P20) at varying concentrations (31~500 nM) prior to analysis. Samples were injected over the sensor surface at a flow rate of 30 µL/min over 1 min. Following completion of the association phase, dissociation was monitored in HBS-EP buffer for 3 min at the same flow rate or for 30 minutes at 37° C. for antibodies with slow koff. At the end of each cycle, the surface was regenerated using 10 mM NaOH at a flow rate of 50 µL/min over 30 sec. The biosensor curves obtained following injection of the samples over active surface were subtracted from the control curves obtained with the samples injected over reference surface prior to kinetics analysis. The data were analyzed using the Biacore T-200 evaluation software. As shown in FIGS. 16(A)-16(B), the humanized anti-CD33 HIM34 antibodies bind with similar $k_{on}$ and $k_{off}$ as the chimeric form.

These results demonstrate that the antibodies of the present technology or antigen binding fragments thereof, specifically bind to CD33 antigen with high binding affinity. Accordingly, the immunoglobulin-related compositions disclosed herein are useful for detecting CD33 protein in a sample.

Figure 4:
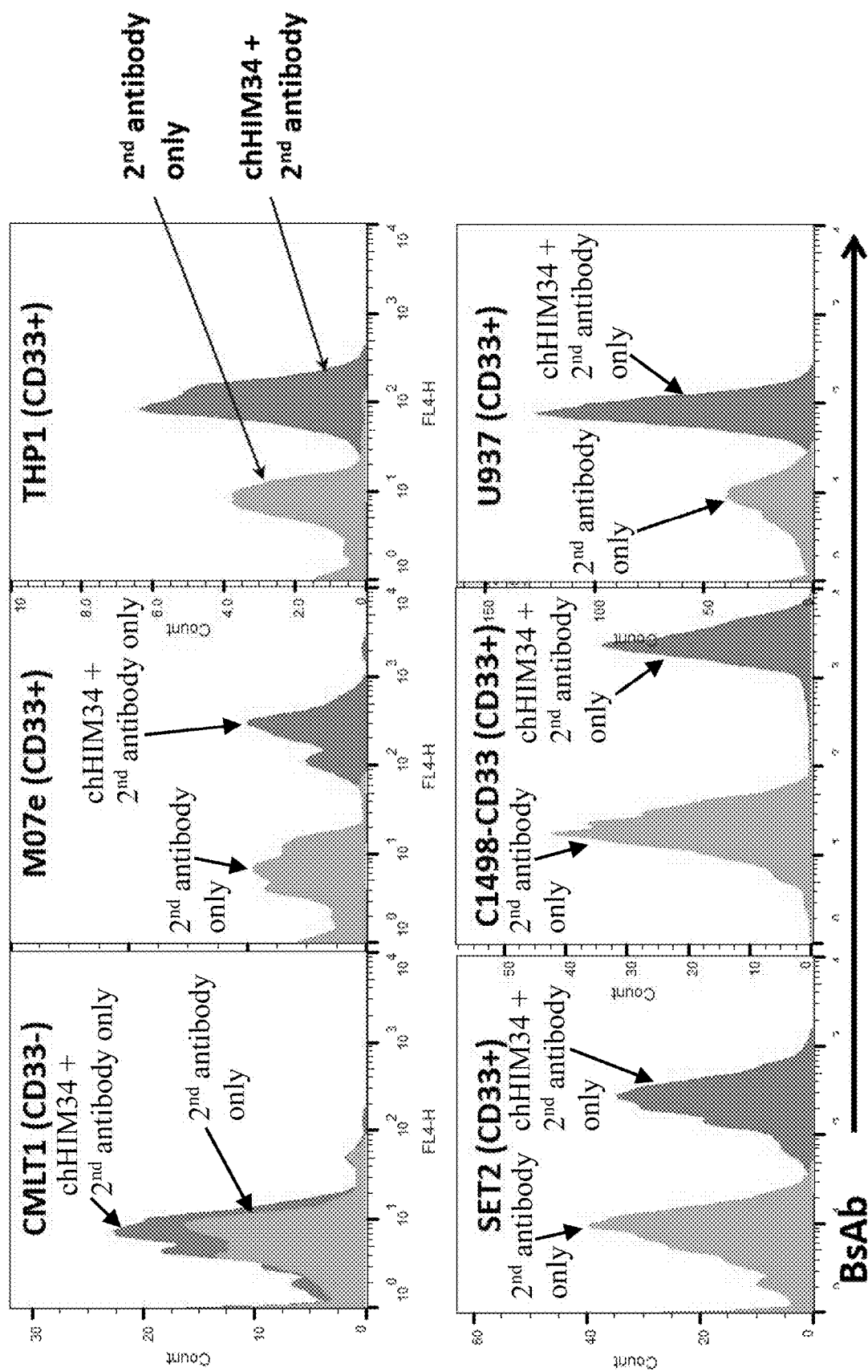
FIG. 4 shows FACS data demonstrating the binding of chimeric HIM34×CD3 bispecific antibody (chHIM34 BsAb) to CD33(+) AML cell lines U937, THP1, SET2, C1498-CD33 and M-07e, while sparing CD33(−) leukemic cell line CMLT1.

Example 2: Biological Activity of T-Cell Engaging CD33-BsAb Antibodies of the Present Technology The chimeric CD33-BsAb binds to AML cell lines. The binding of chHIM34 BsAb to target cells was tested by FACS immunostaining. It bound CD33(+) AML cell lines U937, THP1, SET2, C1498-CD33 and M-07e while sparing CD33(−) leukemic cell lines CMLT1 (FIG. 4).

Figure 5A:
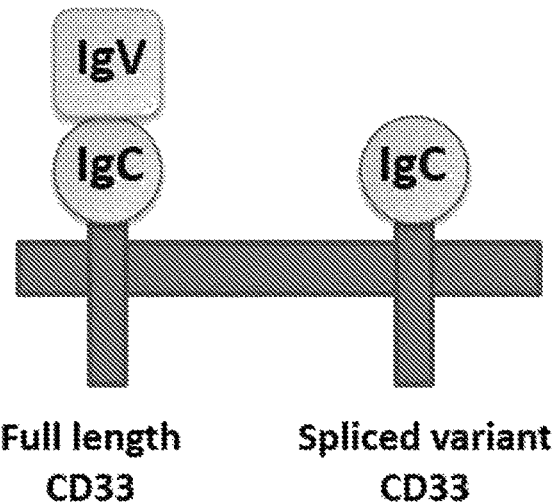
FIG. 5(A) shows a schematic of the full length CD33 protein and the short isoform (splice variant of CD33).
Figure 5B:
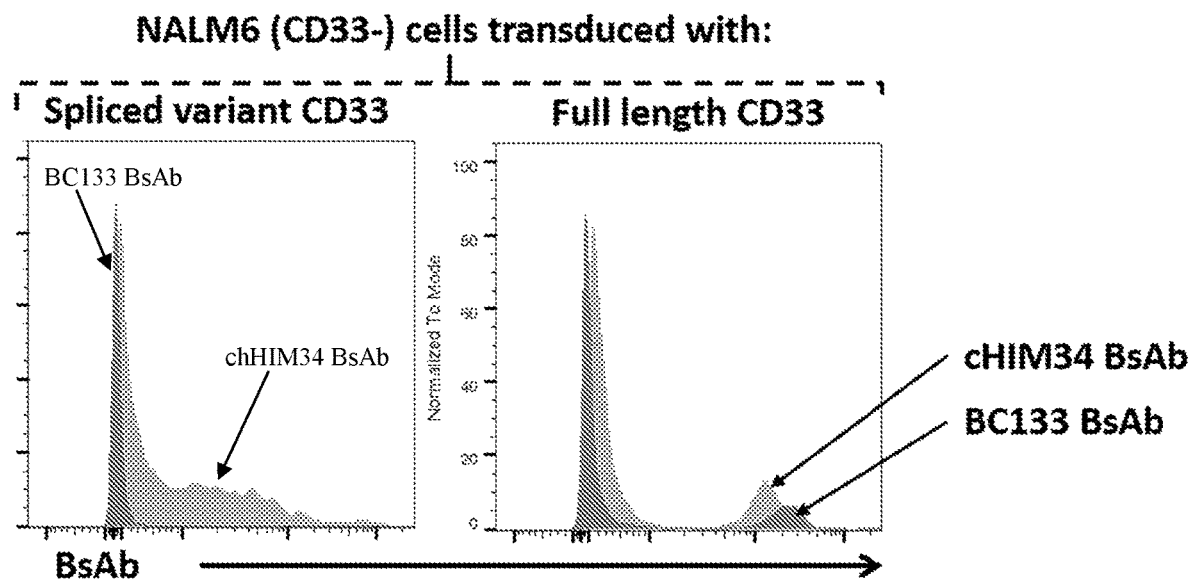
FIG. 5(B) shows FACS data demonstrating that chHIM34 BsAb binds to both the full length and short isoform of CD33 whereas a humanized M195-based BsAb (BC133) does not bind to the short isoform.
Figure 19:
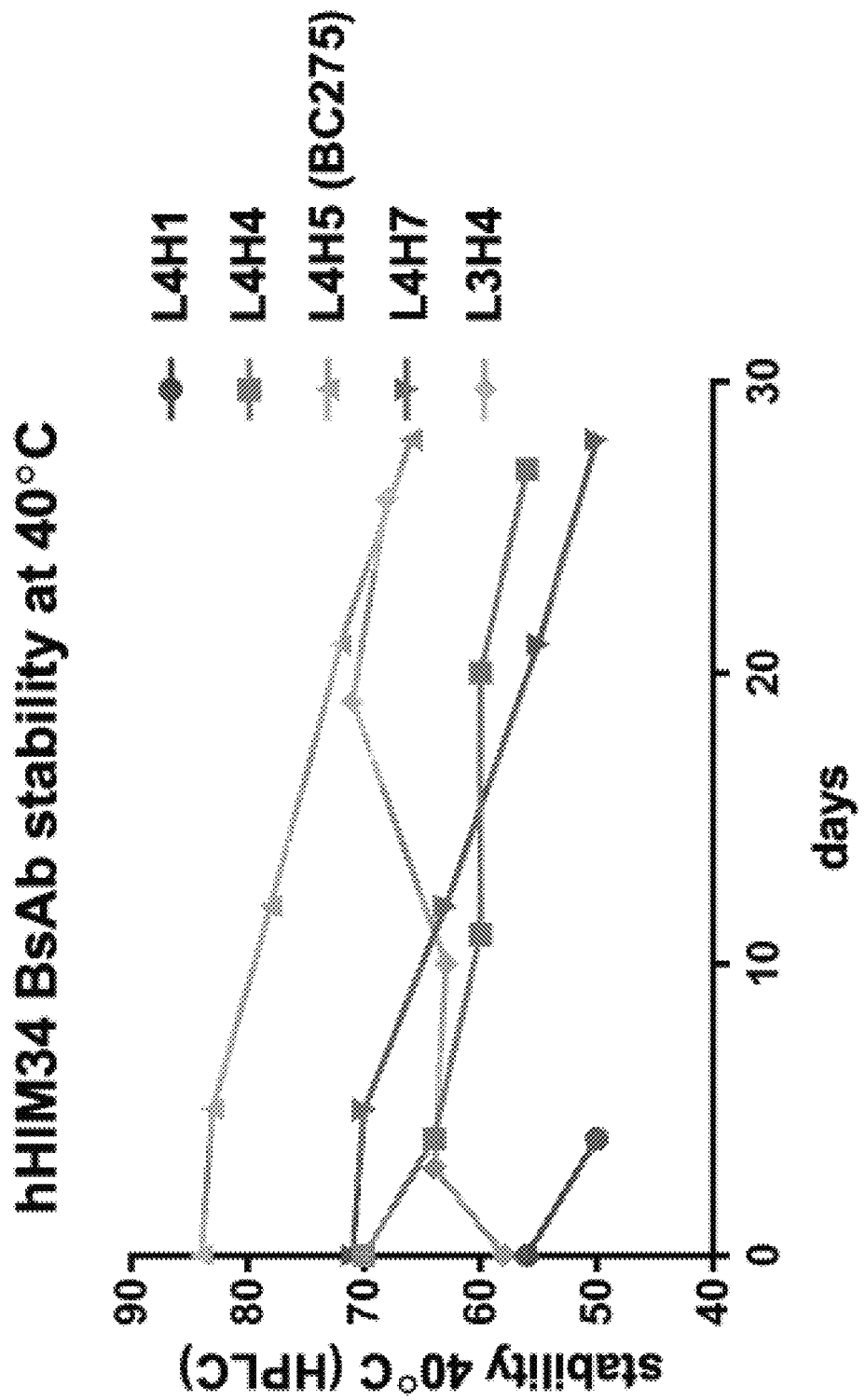
FIG. 19 shows the stability of the humanized BsAbs of the present technology at 40° C.

The chimeric CD33-BsAb binds to both the splice variant and full-length CD33. The full length CD33 molecule has two extracellular domains: the membrane distal IgV and the membrane proximal IgC2 domain (FIG. 1). There is no FDA-approved antibody that binds to the CD33 splice variant that is missing the IgV domain (FIG. 2). Importantly, since 50% of AML patients have the spliced CD33 protein, they cannot benefit from the current CD33 antibody drugs. The chimeric CD33-BsAb, chHIM34 BsAb, of the present disclosure binds to both the full length and the splice variant of CD33 whereas a humanized M195-based BsAb (BC133) does not bind to the splice variant CD33 (FIGS. 5(A)-5(B)). FIG. 19 shows the stability of the humanized BsAbs of the present technology (hHIM34×CD3) at 40° C., using HPLC. Among all tested clones, hHIM34 L4H5 (BC275) clone shows the highest stability at 40° C.

Figure 6A:
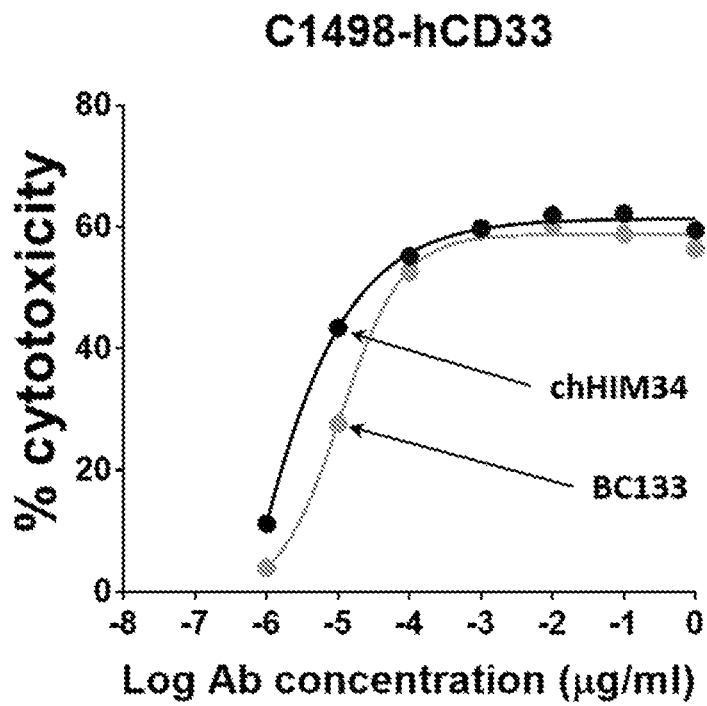
FIGS. 6(A) and 6(B) show a T cell dependent cytotoxicity assay with chHIM34 BsAb on CD33(+) AML cell lines C1498-CD33 and THP1, respectively.
Figure 6B:
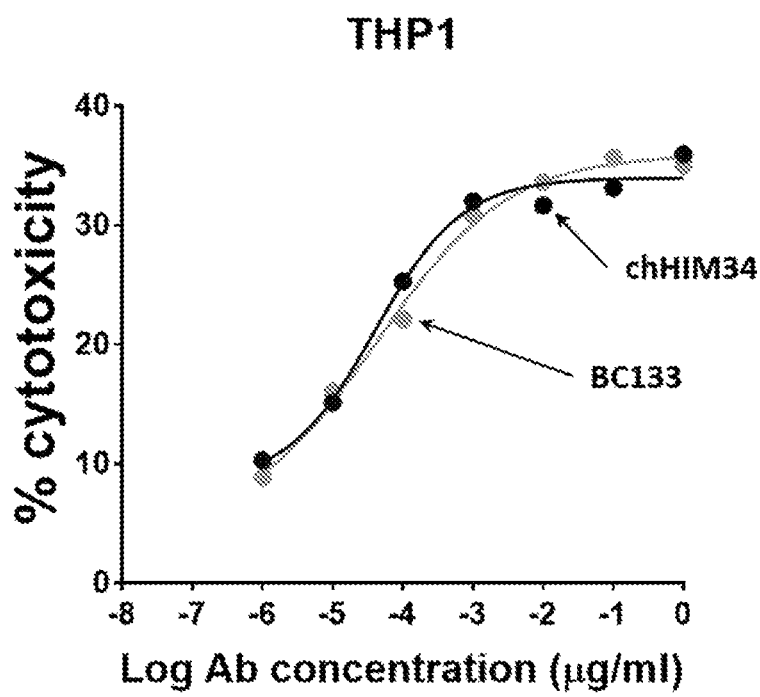

The chimeric CD33-BsAb redirects T-cells to kill CD33 (+) AML cell lines. To evaluate whether the chimeric CD33-BsAb could redirect T cells to kill leukemic cells, T cell cytotoxicity on CD33(+) AML cells was tested in standard 4-hour 51Cr release assays. When chHIM34 BsAb was present, substantial killing of AML cell lines was observed with an EC50 of as low as 1 fM (for C1498-CD33) to 200 fM (for THP1) (FIGS. 6(A)-6(B)).

Comparative binding kinetics of chimeric and humanized forms of the HIM34 Bispecific Antibodies by surface plasmon resonance. The affinity of the humanized HIM34 BsAb against CD33 was tested using surface plasmon resonance technology. The results are shown below:

|  | ka (1/Ms) | kd (1/s) | KD (M) |
|---|---|---|---|
| chH34 | 914000 | 0.000117 | 1.28E−10 |
| L3H4 | 1840000 | 0.00175 | 9.55E−10 |
| L4H1 | 4950000 | 0.00597 | 1.21E−09 |
| L4H4 | 4500000 | 0.00743 | 1.65E−09 |
| L4H5 | 692000 | 0.000154 | 2.22E−10 |
| L4H7 | 861000 | 0.00017 | 1.98E−10 |

Figure 17:
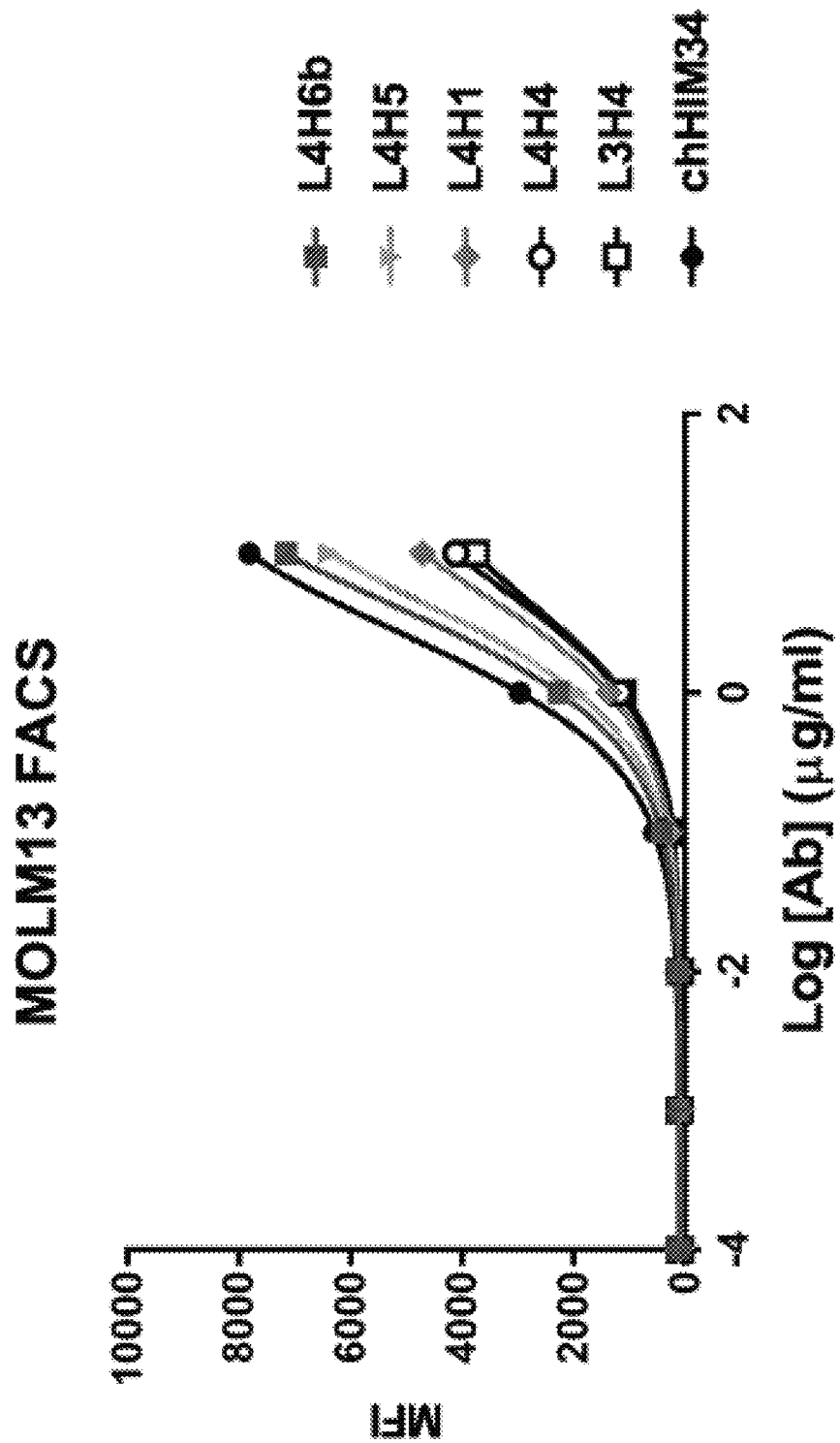
FIG. 17 shows FACS analysis of MOLM13 CD33(+) cells that were contacted with different concentrations of the humanized CD33 BsAbs of the present technology.
Figure 18A:
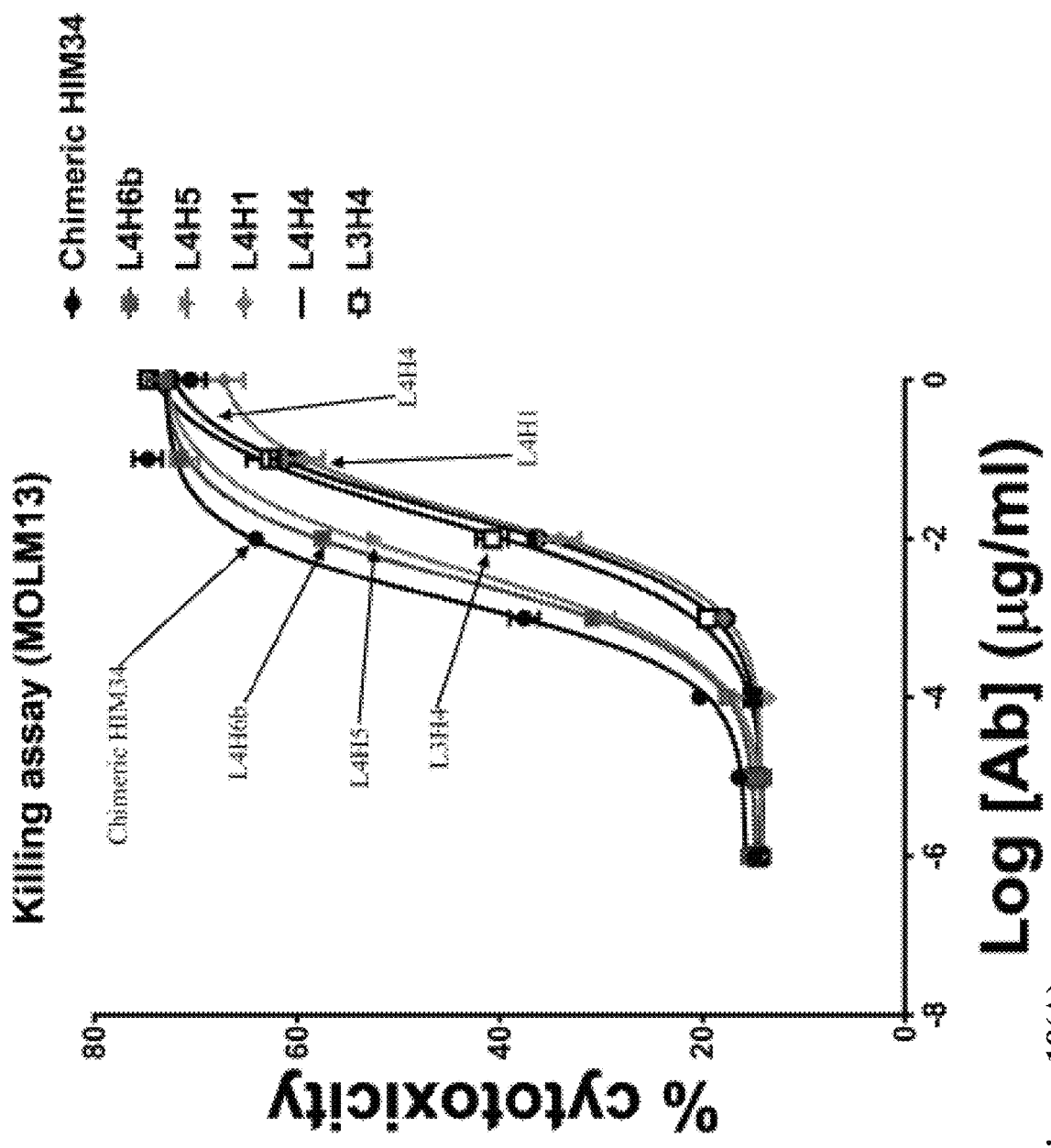
FIGS. 18(A)-18(B) show the cytotoxicity of the humanized BsAbs of the present technology against MOLM13 CD33(+) cells in a T cell dependent cytotoxicity assays (TDCC).
Figure 18B:
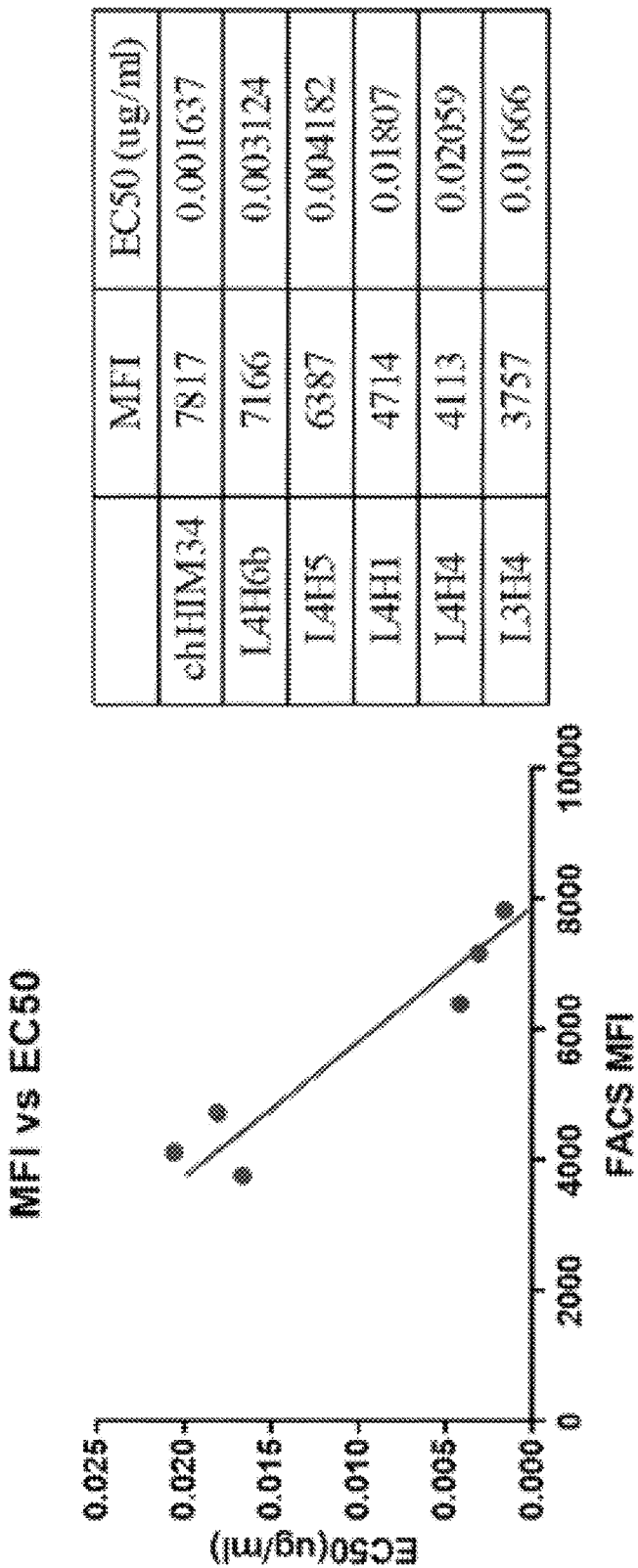

Mean Fluorescent Intensity (MFI) is a reliable criterion to predict in vitro potency of the CD33 antibodies of the present technology. To test the binding of the humanized HIM34 BsAbs, MOLM13 CD33(+) cells were contacted with different concentrations of the humanized anti-CD33 BsAbs disclosed herein. The flow cytometry results are shown in FIG. 17. The cytotoxicity of the humanized BsAbs were tested against MOLM13 cell in T cell dependent cytotoxicity assays (TDCC). As shown in FIGS. 18(A)-18(B), the clones with superior binding to CD33 (higher MFI) were more potent (lower EC50). These results demonstrate that MFI is a reliable criterion to predict in vitro potency of the CD33 antibodies of the present technology.

These results demonstrate that the antibodies of the present technology or antigen binding fragments thereof, specifically target CD33-positive cancer cells. Accordingly, the immunoglobulin-related compositions disclosed herein are useful for detecting and treating CD33-associated cancers in a subject in need thereof.

Example 3: In Vivo Therapy Studies Using CD33-BsAb

Figure 7A:
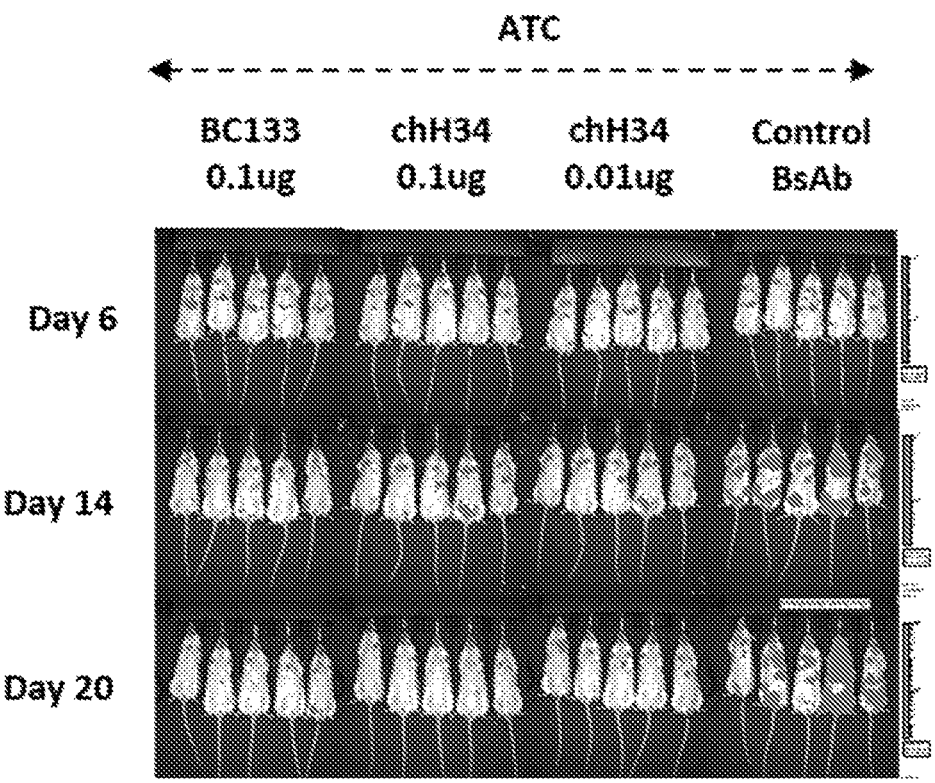
FIG. 7(A) shows bioluminescence images showing growth of MOLM13 AML tumors in different groups.
Figure 7B:
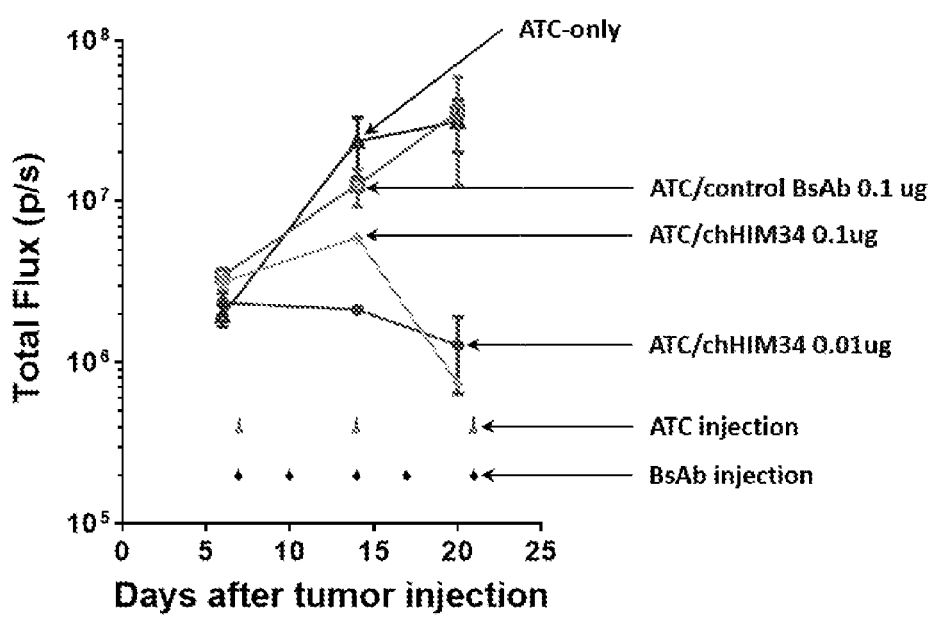
FIG. 7(B) shows the quantification of signals from mice from different groups in FIG. 7(A).

The prognosis of patients with the FMS-like tyrosine kinase-3 (FLT3) internal tandem duplication (ITD) mutations (FLT3/ITD) is generally poor. In pediatric AML, the negative consequences of these mutations is more prominent (Levis and Small, Leukemia 17:1738-52 (2003)). To evaluate whether the chimeric CD33-BsAb can redirect T cells to AMLs with FLT3/ITD mutations, in vivo experiments with NOD.Cg-Prkdcscid Il2rgtm1Wjl Tg(CMV-IL3,CSF2, KITLG)1Eav/MloySzJ (NSGS) mice were performed. Mice were randomized in 4 groups and all received 1 million MOLM13 cells containing the firefly luciferase gene: Group 1: Activated T cell (ATC) only; Group 2: ATC plus chHIM34 BsAb (0.1 µg/dose); Group 3: ATC plus control BsAb (0.1 µg/dose); and Group 4: ATC plus chHIM34 BsAb (0.01 µg/dose). Treatment started at day 7, when the leukemia was established. For three weeks, mice received weakly injection of 10 million ATC mixed with the BsAb. BsAb was administered twice/week, one time mixed with ATC and the other time alone. Totally, five doses of BsAb were injected. To support T cell growth in vivo, 1000 IU of interleukin-2 was administered subcutaneously twice per week. Bioluminescence imaging was performed weekly to evaluate the leukemia burden. As shown in FIGS. 7(A)-7(B), administration of ATCs in the presence of 100 or 10 ng/dose chHIM34 BsAb treated the leukemic mice. However, 100 ng/dose of a control BsAb plus ATCs had no anti-tumor effect, similar to the ATC-only group.

Accordingly, the immunoglobulin-related compositions disclosed herein are useful for detecting and treating a CD33-associated cancer in a subject in need thereof.

Figure 20A:
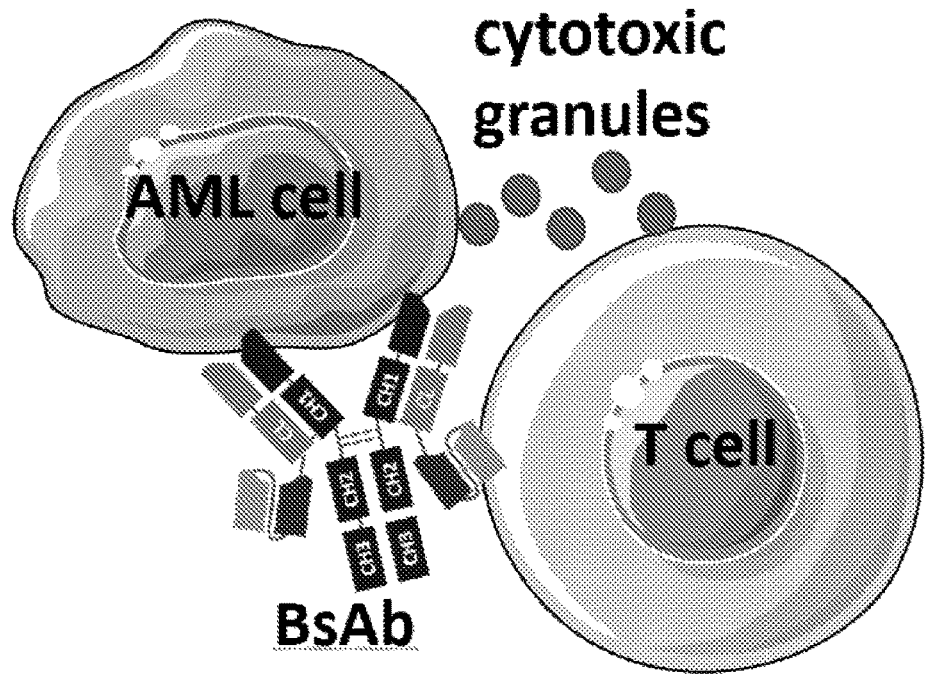
FIG. 20(A) shows a T-cell engaging bispecific antibody (BsAb) recruiting a T cell to an AML cell.
Figure 20B:
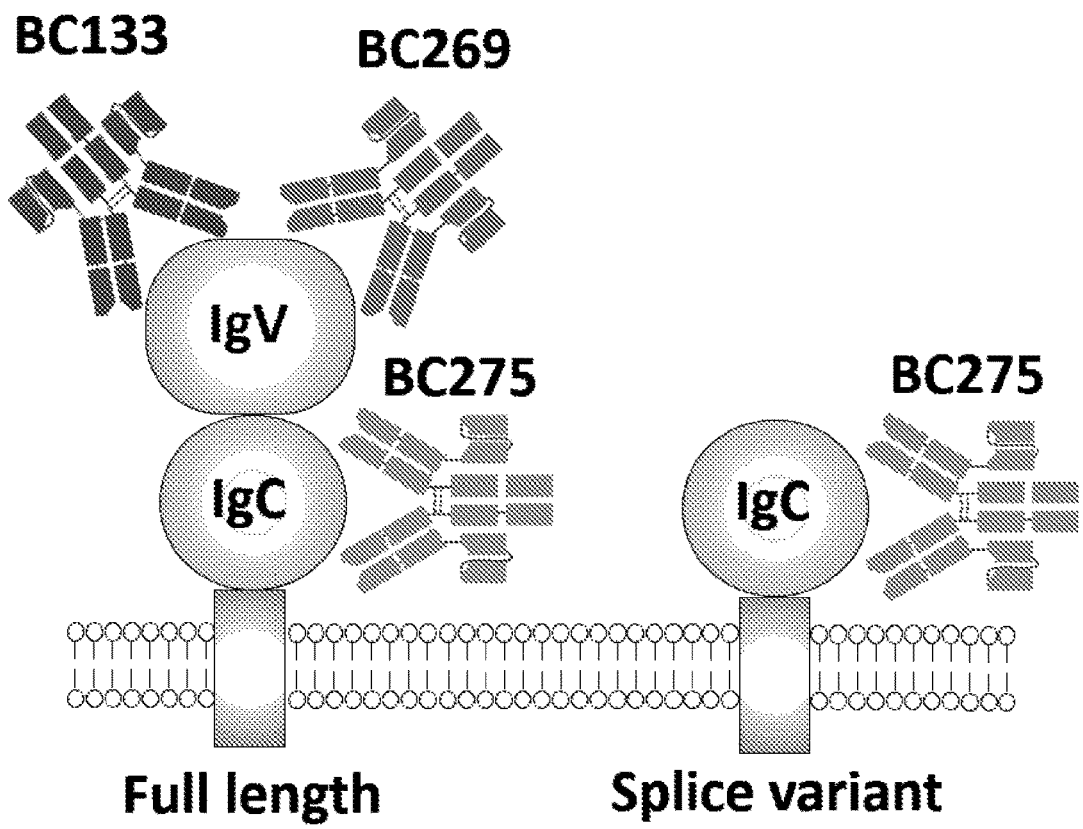
FIG. 20(B) shows that the BC275 BsAb disclosed herein binds the membrane proximal domain (IgC) of the extracellular region of CD33, whereas BC133 based on M195 clone (Lintuzumab) and BC269 based on My96 (Gemtuzumab), bind the membrane distal domain of the CD33 extracellular region.
Figure 20C:
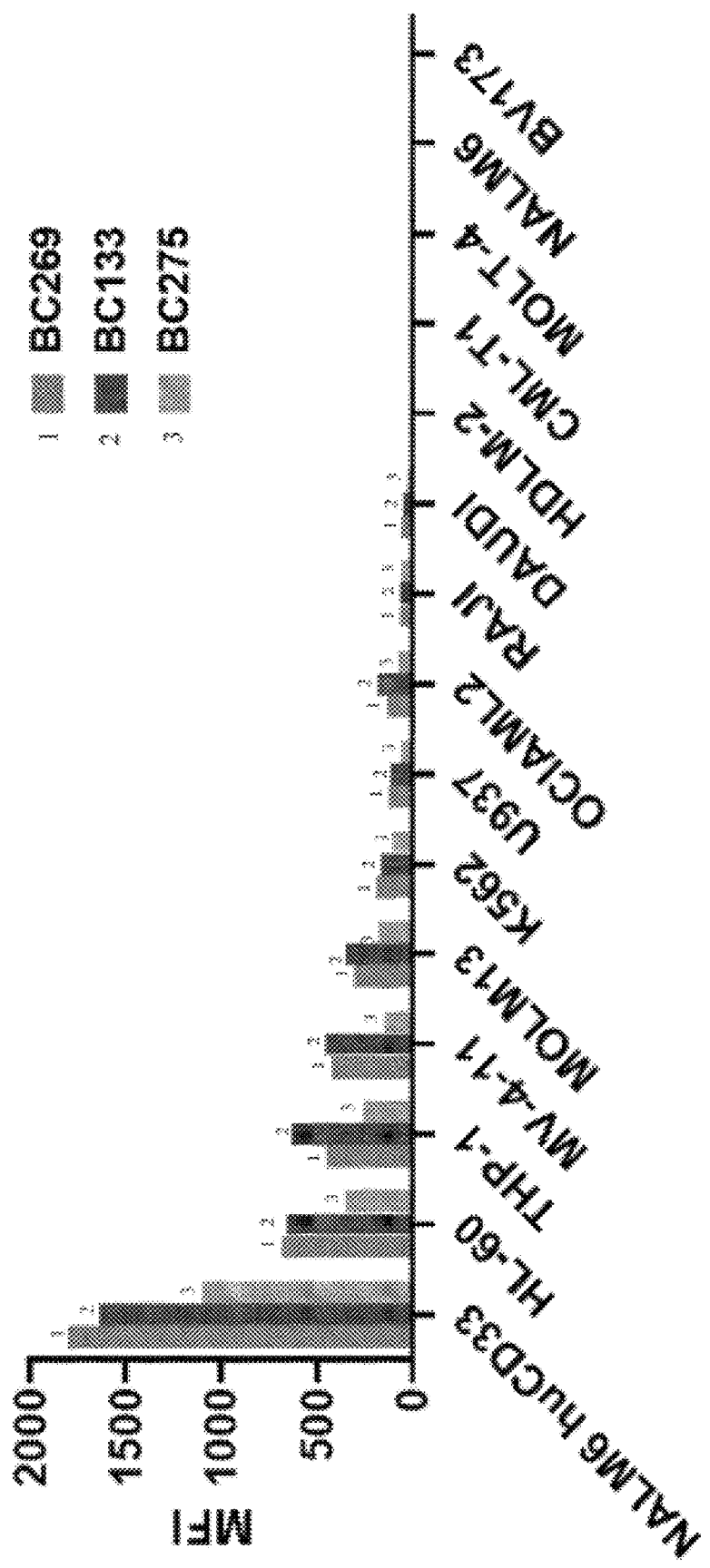
FIG. 20(C) shows the CD33 binding properties of the BC275, BC133, and BC269 BsAbs towards various CD33(+) and CD33(−) human cancer cell lines.
Figure 21A:
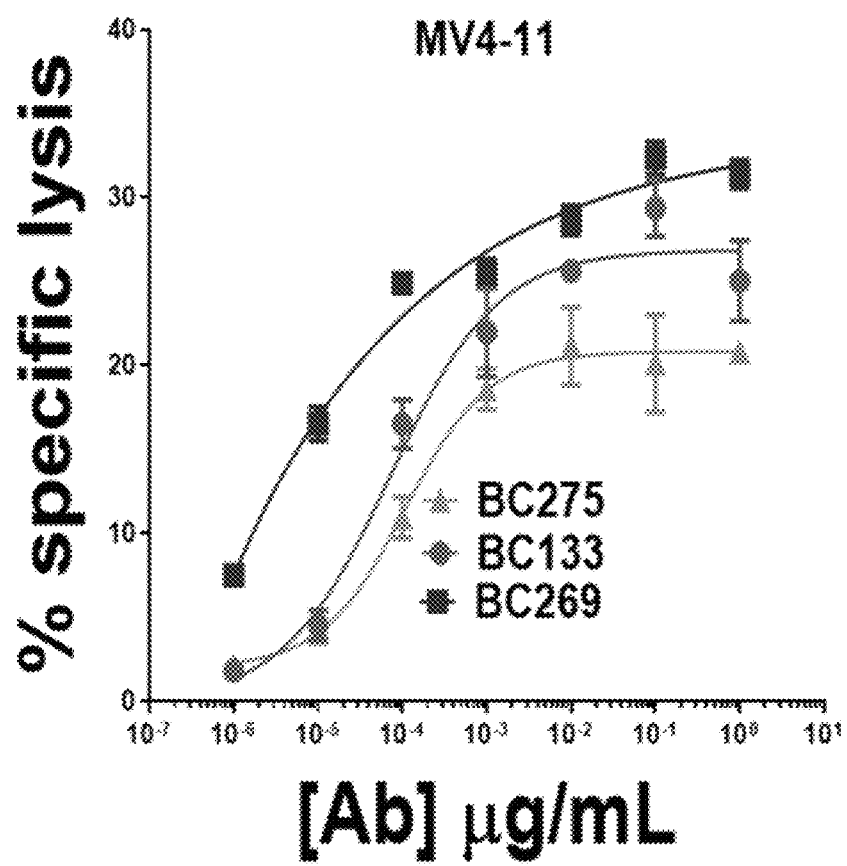
FIGS. 21(A)-21(C) show the T-cell dependent cell mediated cytotoxic effects of the BC275, BC133, and BC269 BsAbs towards CD33(+) and CD33(−) human cancer cell lines.
Figure 21B:
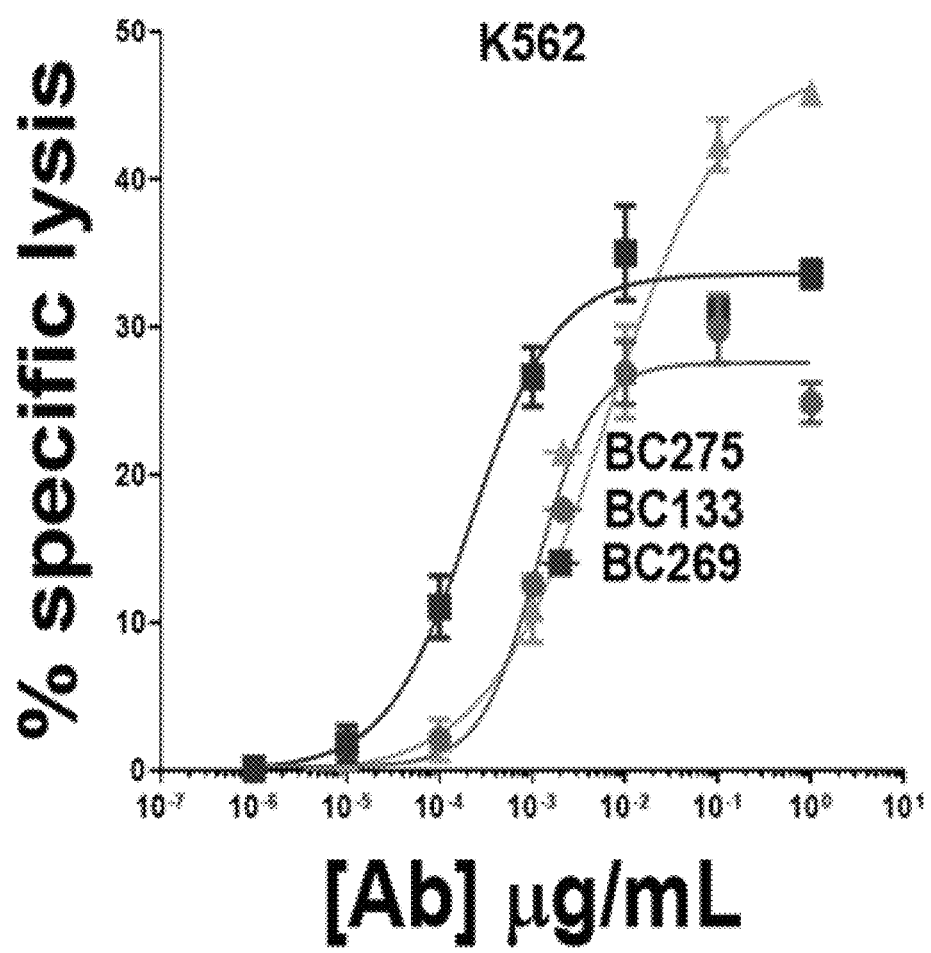
Figure 21C:
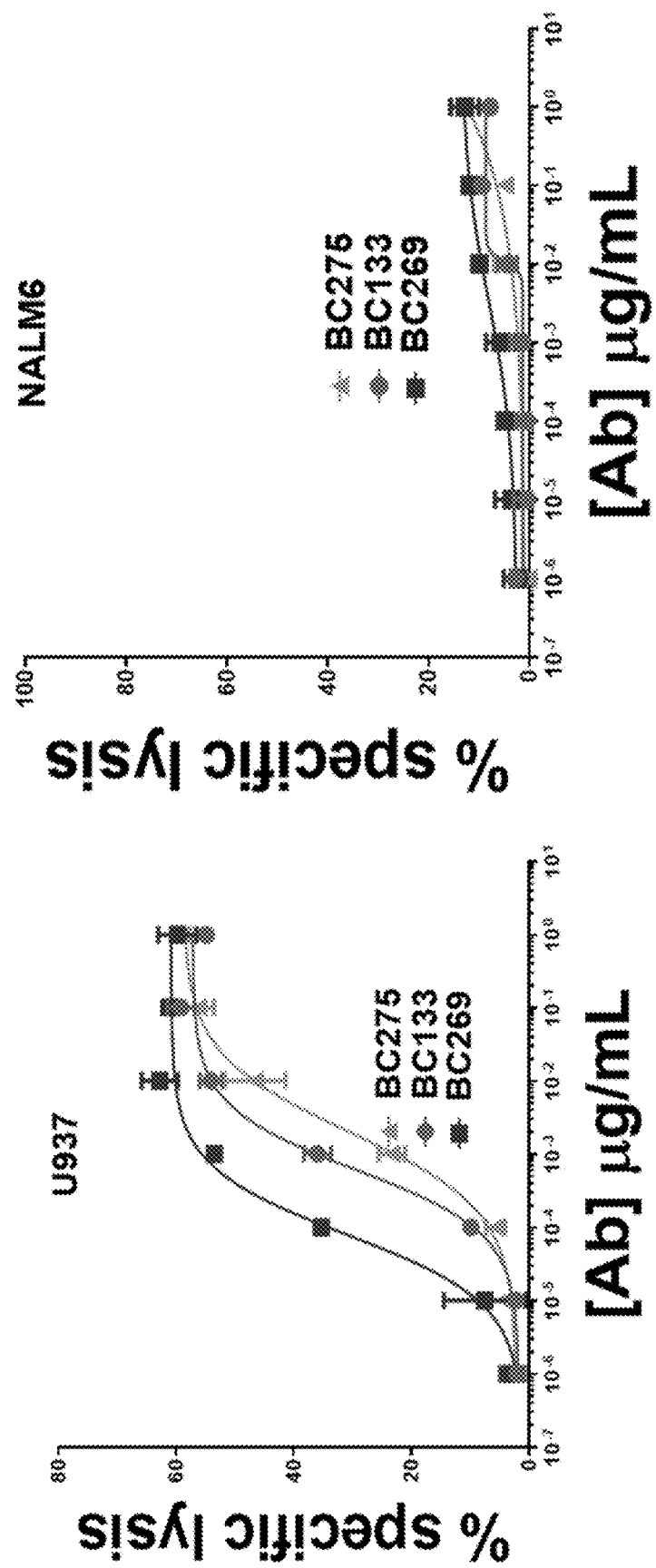
Figure 21D:
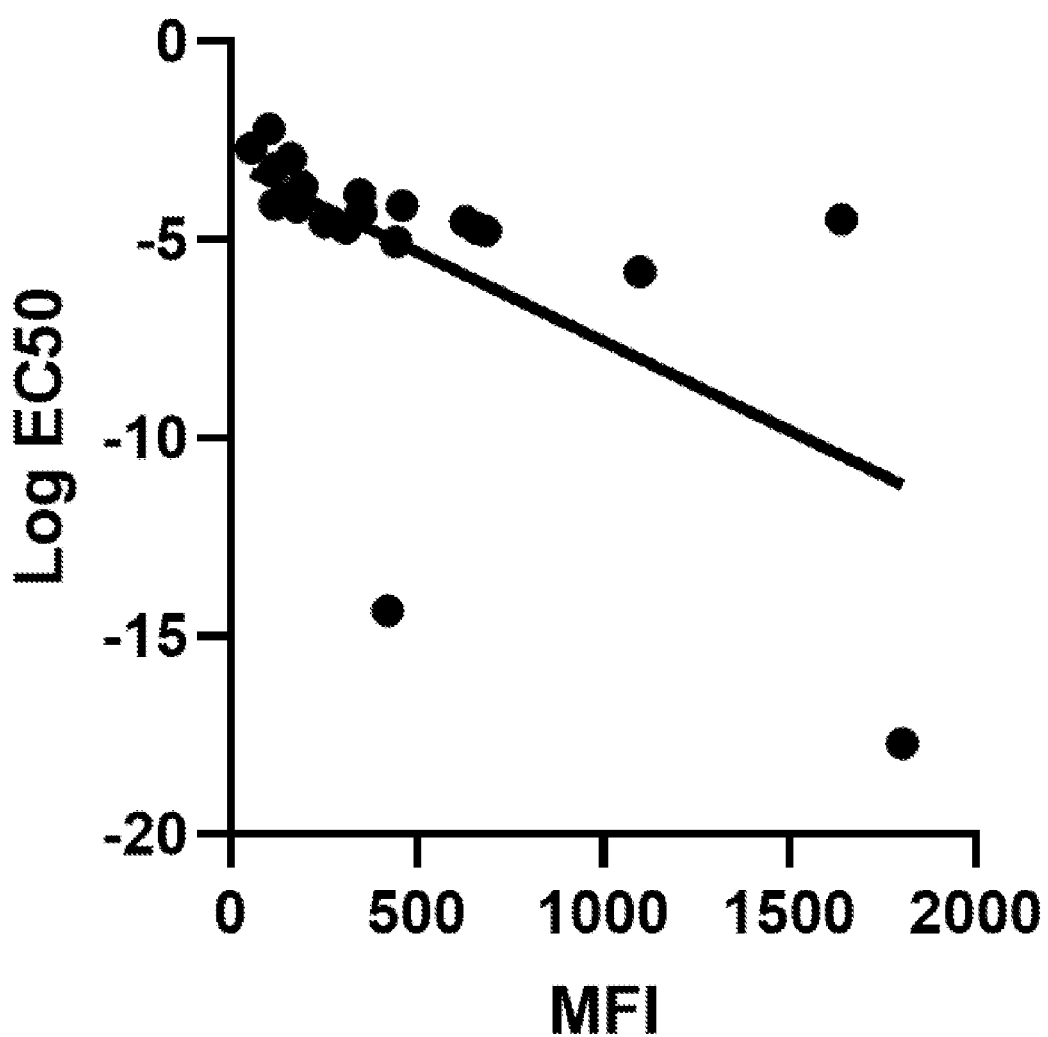
FIG. 21(D) plots the correlation between the level of CD33 expression on cancer cells and the potency of the test BsAb in TDCC assays. Pooled data of all three CD3×CD33 BsAbs are shown.

Example 4: Comparative Activities of Anti-CD33 BsAb of the Present Technology Versus Existing CD33 Antibodies The BC275 (CD3×CD33) BsAb disclosed herein binds the membrane proximal domain (IgC) of the extracellular region of CD33. See FIGS. 20(A)-20(B). Examples of other existing CD3×CD33 BsAbs, BC133 based on M195 clone (Lintuzumab) and BC269 based on My96 (Gemtuzumab), bind the membrane distal domain of the CD33 extracellular region (FIG. 20(B)). Various CD33(+) and CD33(−) human cancer cell lines were contacted with the three bispecific antibodies to evaluate their binding to CD33. A secondary antibody was used to detect BsAb binding to the human cancer cell lines. As shown in FIG. 20(C), all three BsAbs bind CD33(+) cells, but do not react with the CD33(−) cells. Activated human T cells were mixed with various CD33(+) or CD33(−) (NALM6) cancer cells to assess the T-cell dependent cell mediated cytotoxicity (TDCC) of the three CD3×CD33 BsAbs. As shown in FIGS. 21(A)-21(C), all three BsAbs potently lysed leukemic cells that were CD33 (+) but spared CD33(−) NALM6 cells. These results demonstrate that the CD3×CD33 BsAbs selectively target CD33 (+) cancers. Moreover, there was a positive correlation between the level of CD33 expression on cancer cells and the potency of the BsAb in TDCC assays (pooled data of all three CD3×CD33 BsAbs are shown in FIG. 21(D)).

Figure 22A:
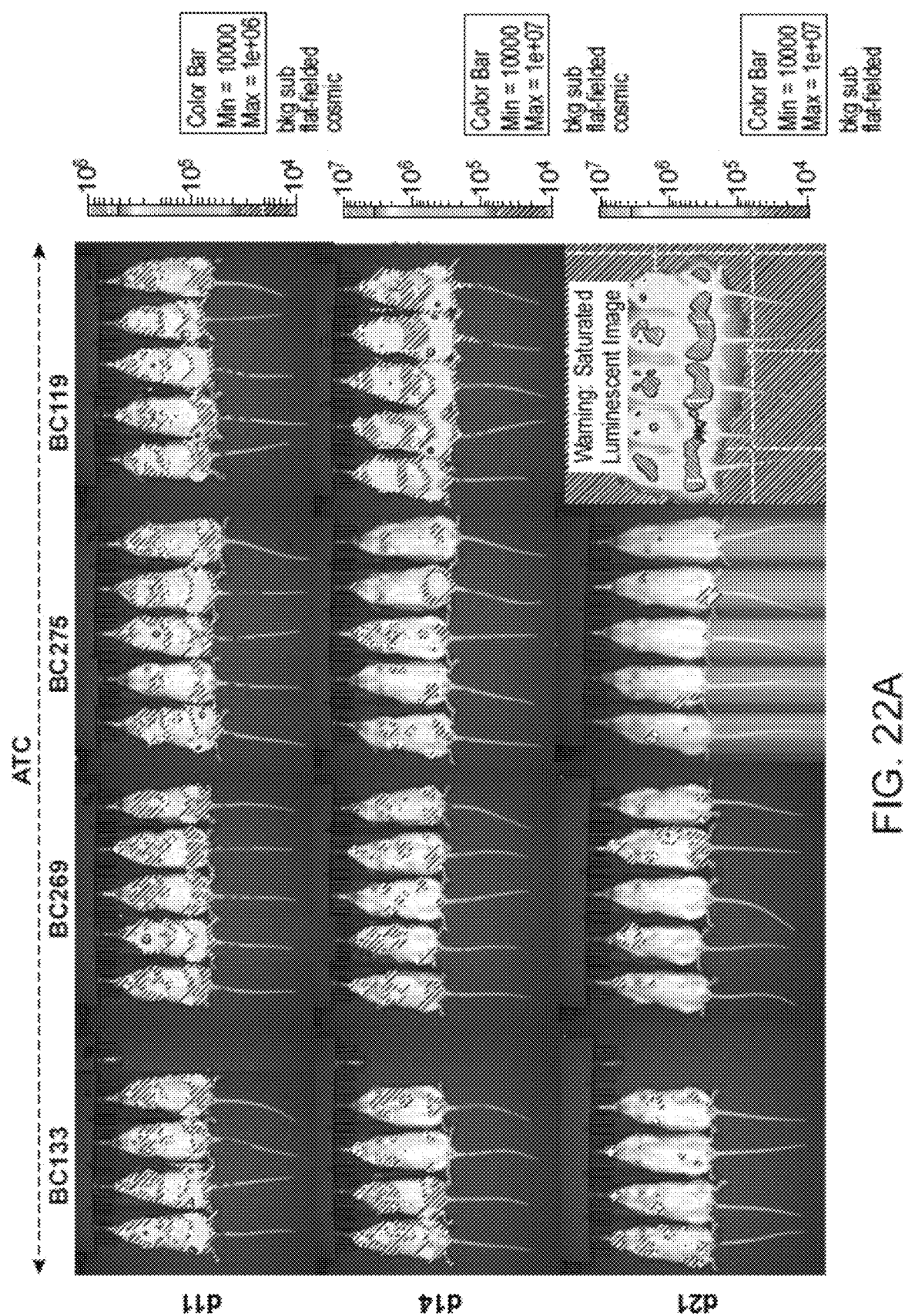
FIGS. 22(A)-22(B) show the tumor size of immunodeficient NSG mice that were intravenously inoculated with CD33(+) MOLM13-luciferase (which has CC genotype for the rs12459419 SNP) human AML xenograft ($10^6$ cells) and subsequently treated with BC275, BC133, and BC269 BsAbs (CD3×CD33 BsAbs) or a control BC119 BsAb (CD3×GD2 BsAb). Mice received a single injection of $5×10^6$ activated T-cells with 0.025 µg of BsAb (10 µg/Kg/dose). The timing of T cell and antibody injections are shown in FIG. 22(B).
Figure 22B:
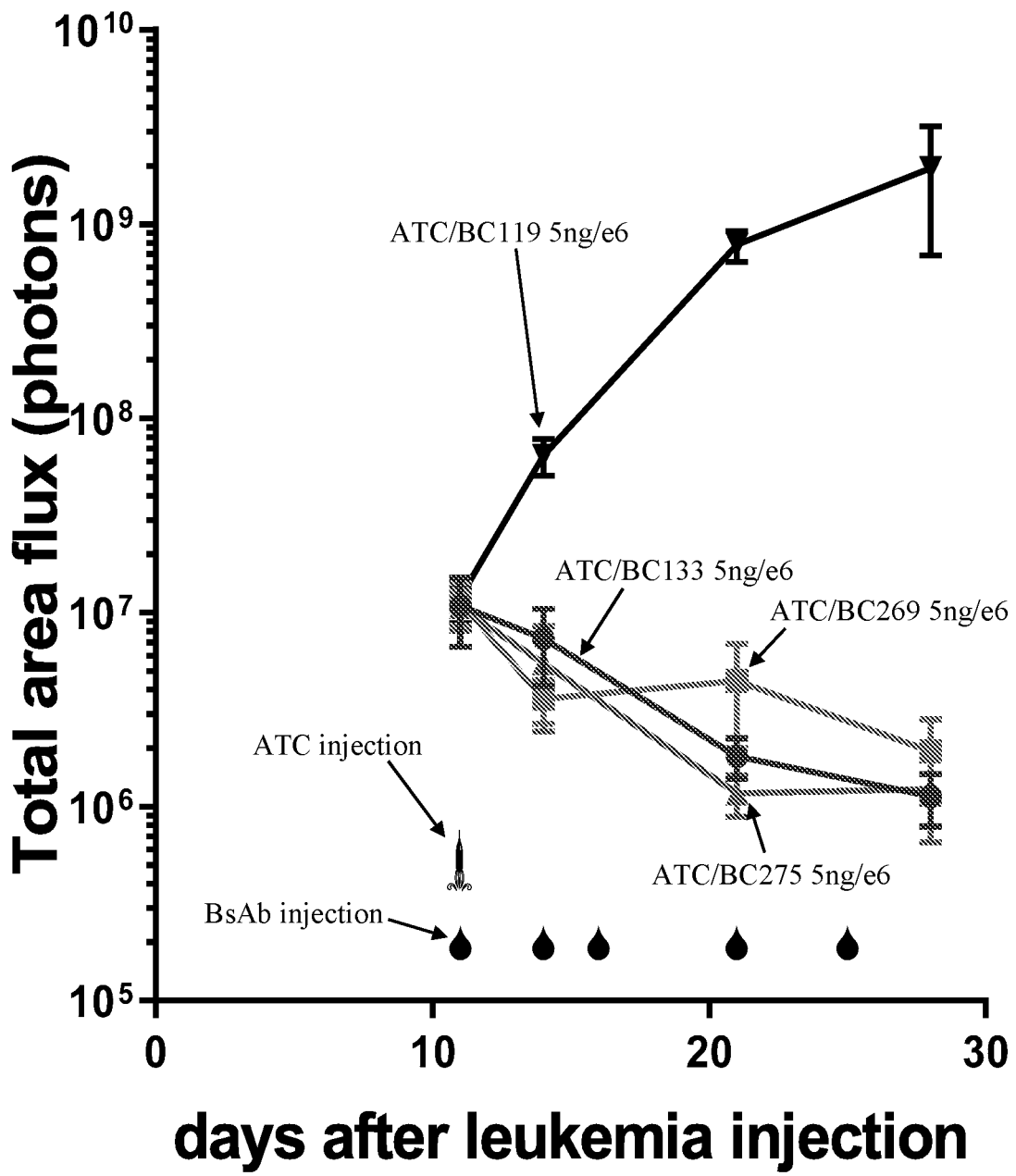

Several animal experiments were performed to assess and compare the potency of the three BsAbs in vivo. In the first experiment, immunodeficient NSG mice were intravenously inoculated with CD33(+) MOLM13-luciferase (which has CC genotype for the rs12459419 SNP) human AML xenograft ($10^6$ cells). Therapy was initiated after 11 days (FIGS. 22(A)-22(B)). Mice received a single injection of $5 \times 10^6$ activated T-cells with 0.025 µg of a test BsAb (10 µg/Kg/dose). The timing of T cell and antibody injections are shown in FIG. 22(B). In the control group, mice received T-cells plus BC119 (CD3×GD2 BsAb). Injection of the BsAbs alone was continued for 4 more doses. Leukemia growth was monitored using an IVIS bioluminescent imager. All three CD3×CD33 BsAbs redirected T cells to treat mice inoculated with AML cells, while mice receiving the control BsAb and T cells showed progression of leukemia (FIGS. 22(A)-22(B)).

Figure 23A:
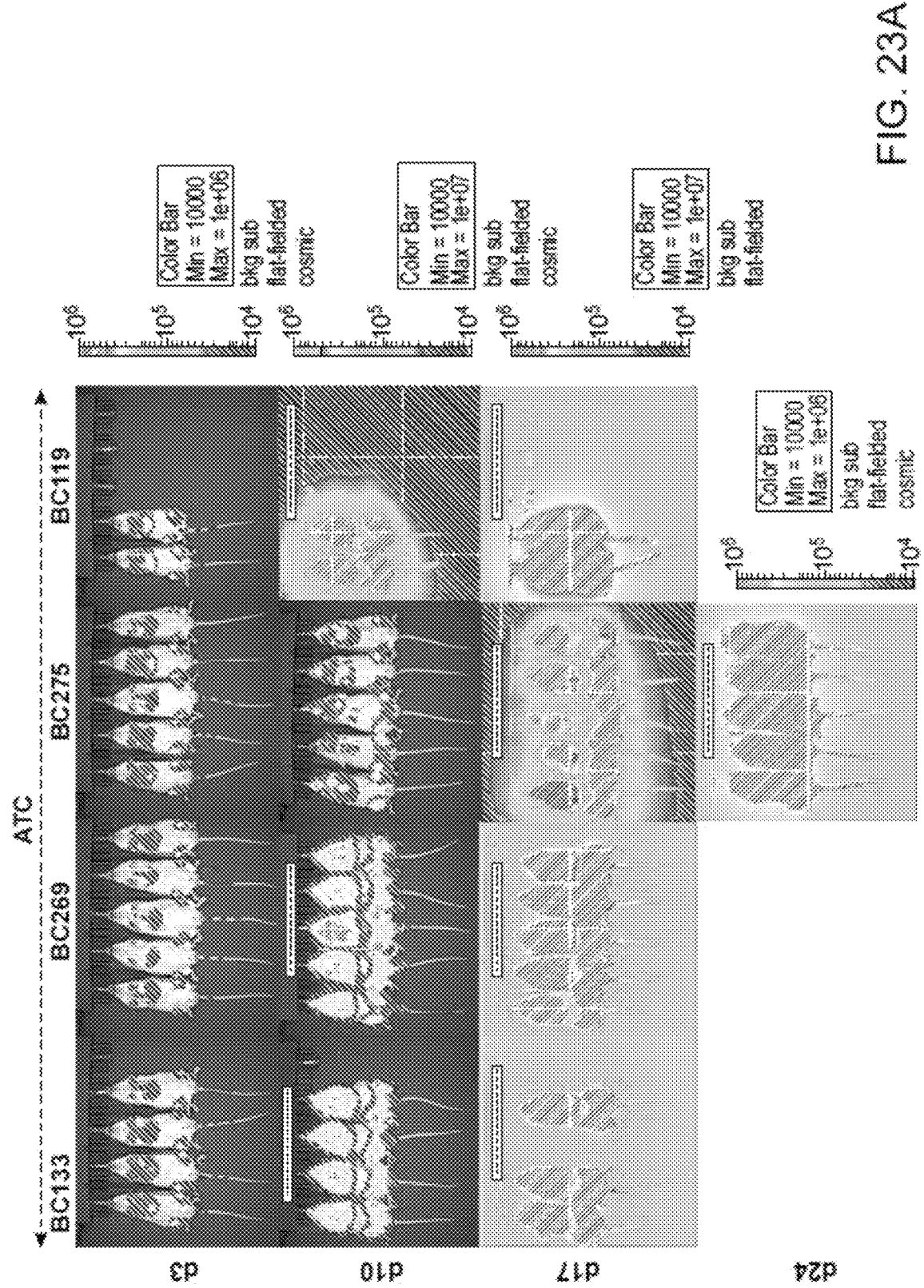
FIGS. 23(A)-23(B) show the tumor size of immunodeficient NSG mice that were intravenously inoculated with human CD33-transduced NALM6-luciferase leukemia xenografts ($0.5×10^6$ cells) and subsequently treated with BC275, BC133, and BC269 BsAbs (CD3×CD33 BsAbs) or a control BC119 BsAb (CD3×GD2 BsAb). Mice received two injections of activated T-cells ($2.7×10^6$ and $5×10^6$, one-week interval between the doses) with 10 ng BsAb/$10^6$ T cells. The timing of T-cell and BsAb injections are shown in FIG. 23(B).
Figure 23B:
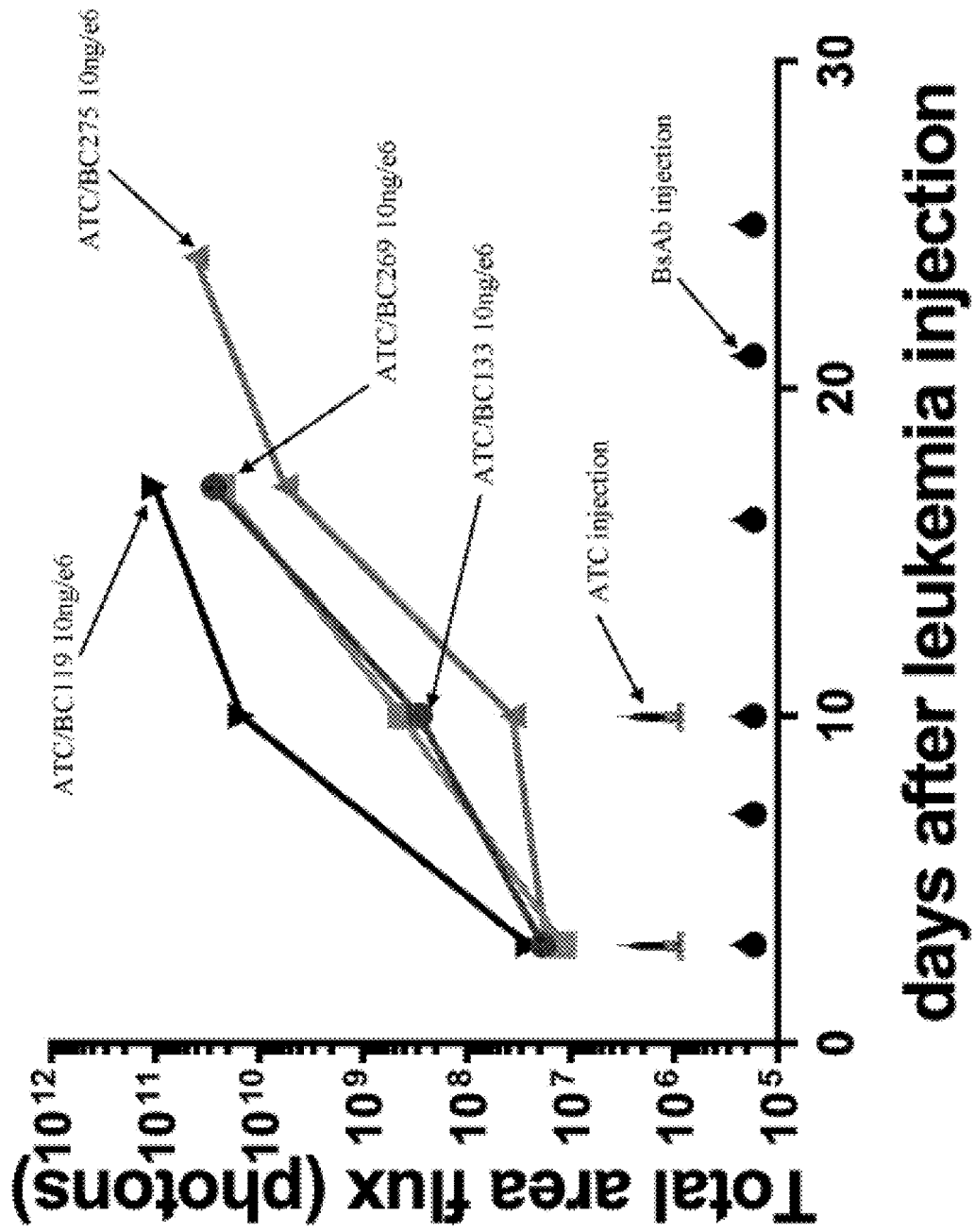
Figure 23C:
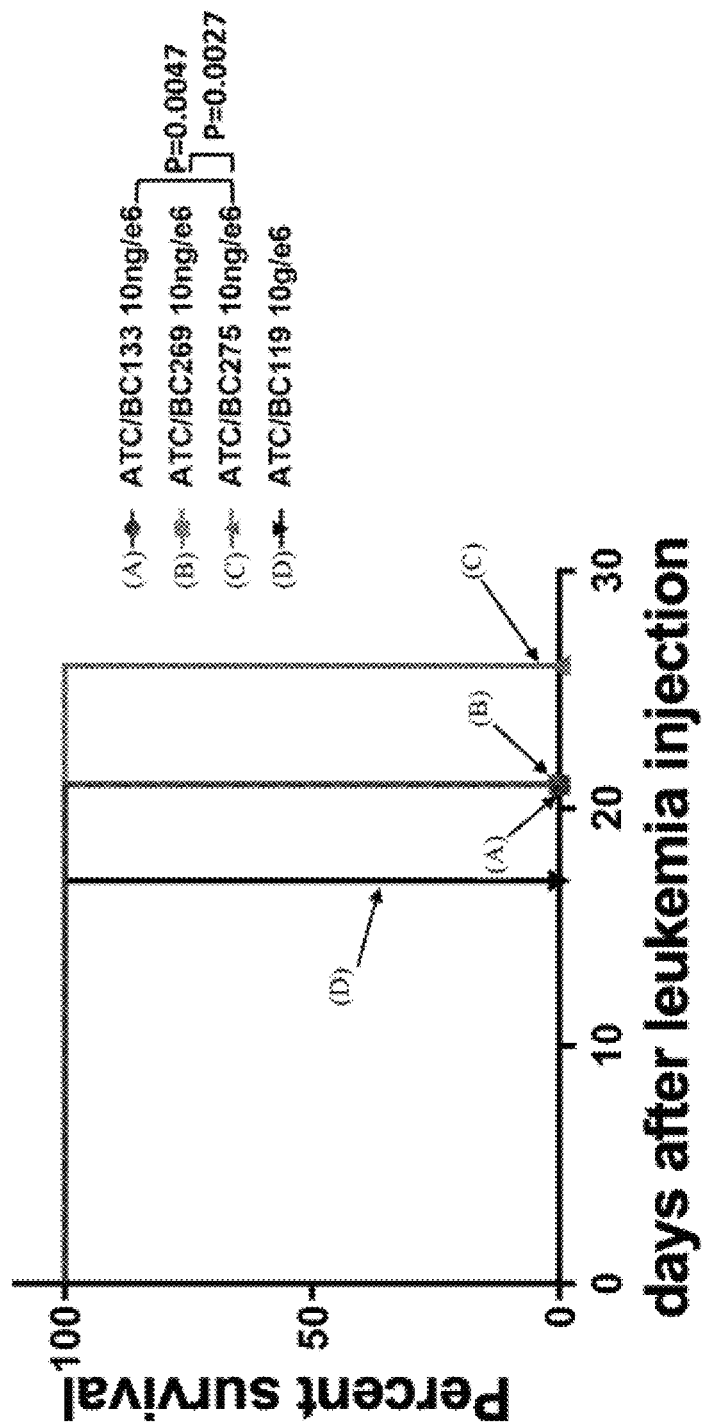
FIG. 23(C) shows the survival curves of animals treated with the three CD3×CD33 BsAbs. The potency of the CD3×CD33 BsAbs was ranked as follows: BC275>BC269=BC133.

Next, immunodeficient NSG mice were intravenously inoculated with human CD33-transduced NALM6-luciferase leukemia xenografts ($0.5 \times 10^6$ cells). Therapy was initiated after 3 days (FIG. 23(A)). Mice received two injections of activated T-cells ($2.7 \times 10^6$ and $5 \times 10^6$, one-week interval between the doses) with 10 ng BsAb/$10^6$ T cells. In the control group, mice received T-cells plus BC119 (CD3×GD2 BsAb). The timing of T-cell and BsAb injections are shown in FIG. 23(B). Leukemia growth was monitored using an IVIS bioluminescent imager. To support T cell engraftment, all mice received 2 subcutaneous injections of interleukin-2 (1000 IU) during the first week of treatment. FIG. 23(C) shows the survival curves of mice treated with the three CD3×CD33 BsAbs. The most potent BsAb was BC275 (the CD33 antibody of the present technology) which promoted a higher degree of survival compared with the conventional BC269 and BC133 BsAbs (which showed equivalent effects).

Figure 24A:
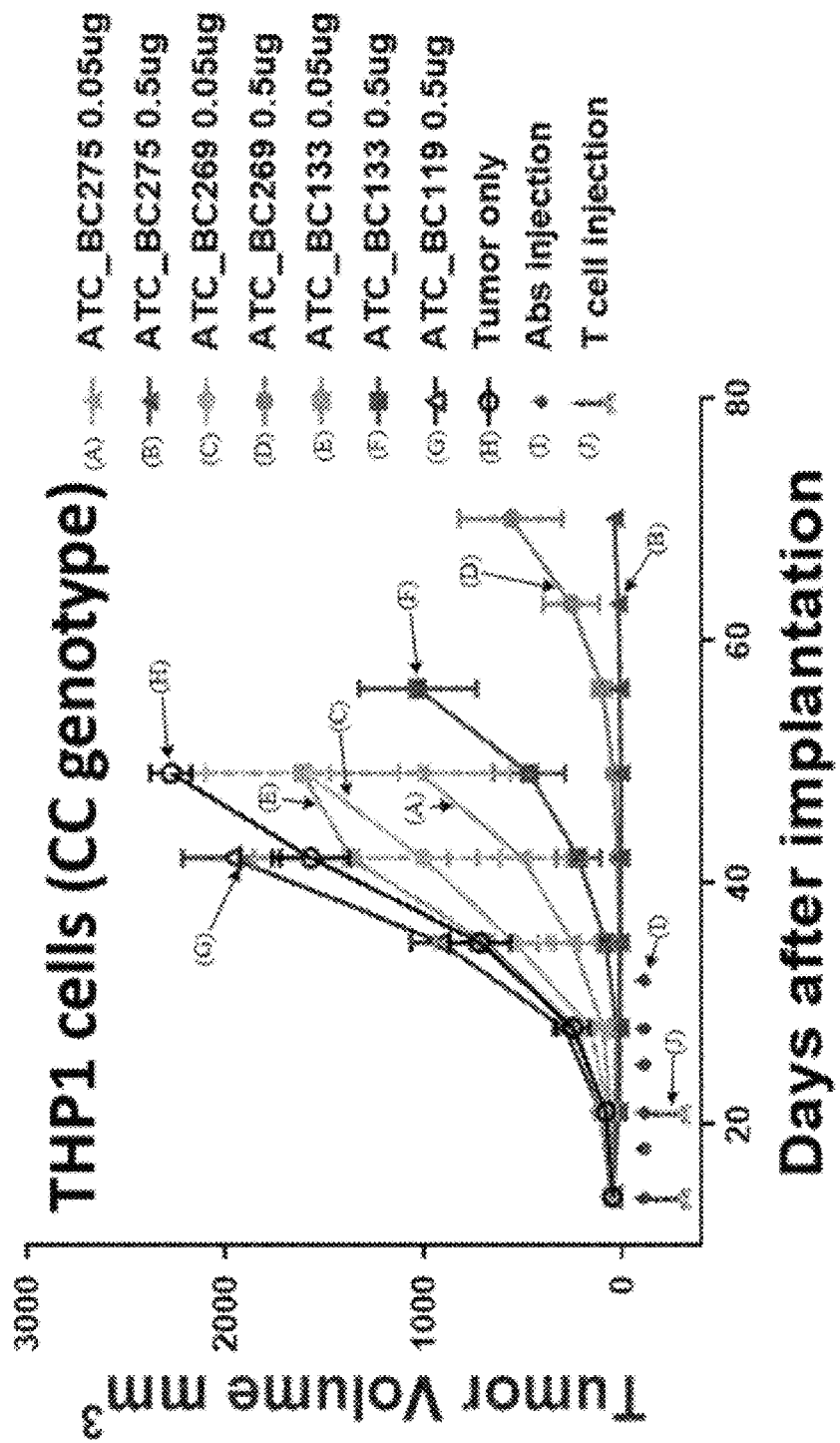
FIGS. 24(A)-24(D) show the tumor size of immunodeficient DKO mice that were subcutaneously inoculated with THP1 human leukemia xenograft (which has the CC genotype for the rs12459419 SNP) and subsequently treated with BC275, BC133, and BC269 BsAbs (CD3×CD33 BsAbs) or a control BC119 BsAb (CD3×GD2 BsAb). Mice received two injections ($10^7$, one-week interval between the doses) of activated T-cells with 0.05 µg or 0.5 µg BsAb (≈2 µg/kg/dose or 20 µg/kg/dose). The timing of T cell and antibody injections are shown in FIG. 24(A). The potency of the CD3×CD33 BsAbs was ranked as follows: BC275>BC269>BC133.
Figure 24B:
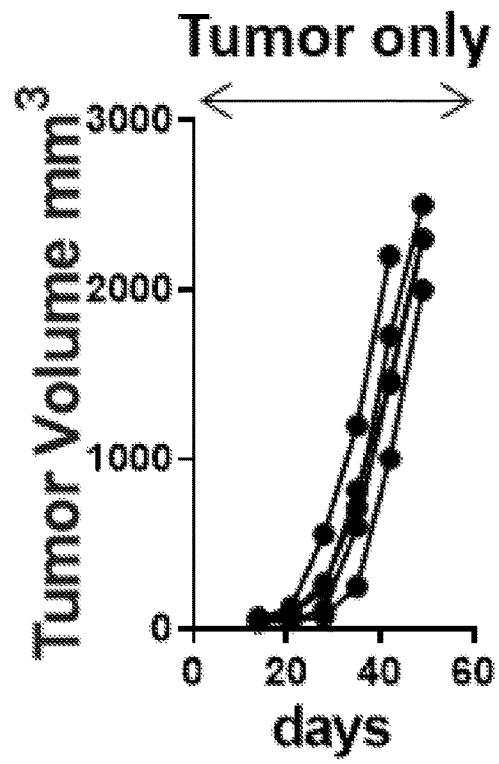
Figure 24C:
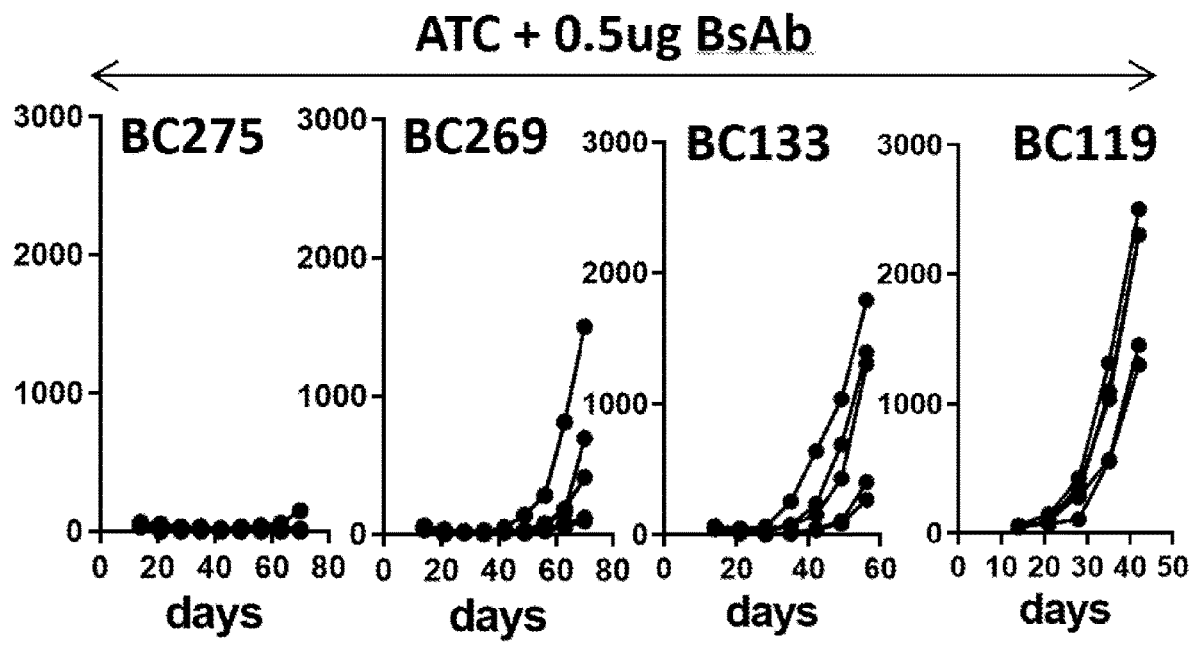
Figure 24D:
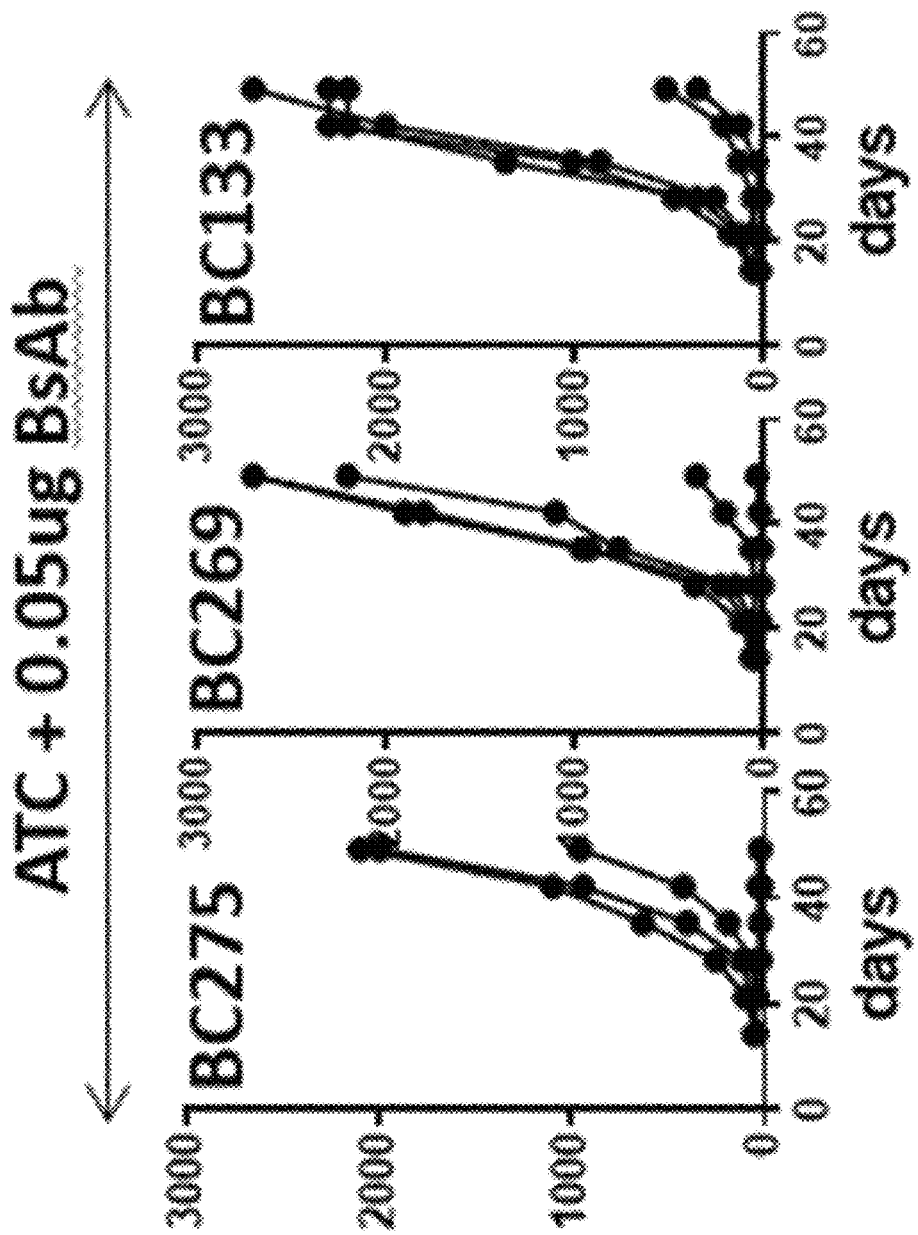

The next experiment was performed on immunodeficient DKO mice that were subcutaneously inoculated with THP1 human leukemia xenograft (which has the CC genotype for the rs12459419 SNP). Therapy was initiated after 14 days (FIGS. 24(A)-24(D)). Mice received two injections ($10^7$, one-week interval between the doses) of activated T-cells with 0.05 µg or 0.5 µg BsAb µg/kg/dose or 20 µg/kg/dose). In the control group, mice received T-cells plus BC119 (CD3×GD2 BsAb). The timing of T cell and antibody injections are shown in FIG. 24(A). Leukemia progression was monitored by measuring tumor size. To support T cell engraftment, all mice received 2 subcutaneous injections of interleukin-2 (1000 IU) per week during the first three weeks of T cell injections. The most potent BsAb was BC275 (the CD33 antibody of the present technology) which showed the highest degree of tumor reduction compared with the conventional BC269 and BC133 BsAbs (i.e., BC275>BC269>BC133).

Figure 25A:
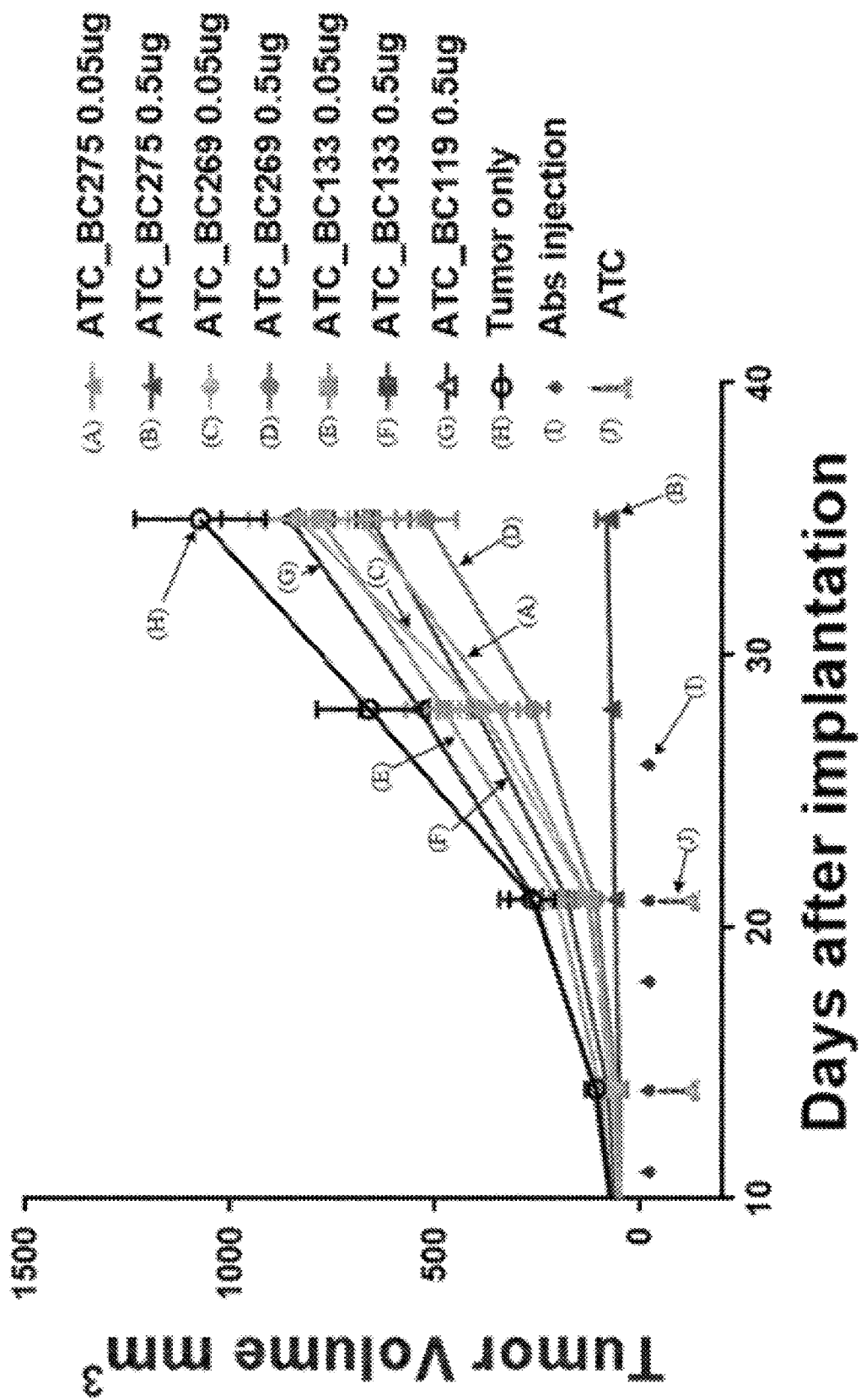
FIGS. 25(A)-25(D) show the tumor size of immunodeficient DKO mice that were subcutaneously inoculated with K562 human leukemia xenografts (which has the TT genotype for the rs12459419 SNP) and subsequently treated with BC275, BC133, and BC269 BsAbs (CD3×CD33 BsAbs) or a control BC119 BsAb (CD3×GD2 BsAb). Mice received three injections ($10^7$, one-week interval between the doses) of activated T-cells with 0.05 µg or 0.5 µg BsAb (≈2 µg/kg/dose or 20 µg/kg/dose). The timing of T cell and antibody injections are shown in FIG. 25(A). The potency of the CD3×CD33 BsAbs was ranked as follows: BC275>BC269>BC133.
Figure 25B:
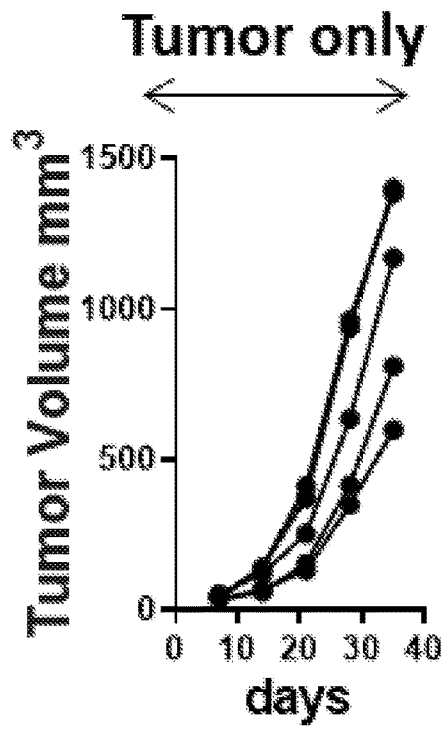
Figure 25C:
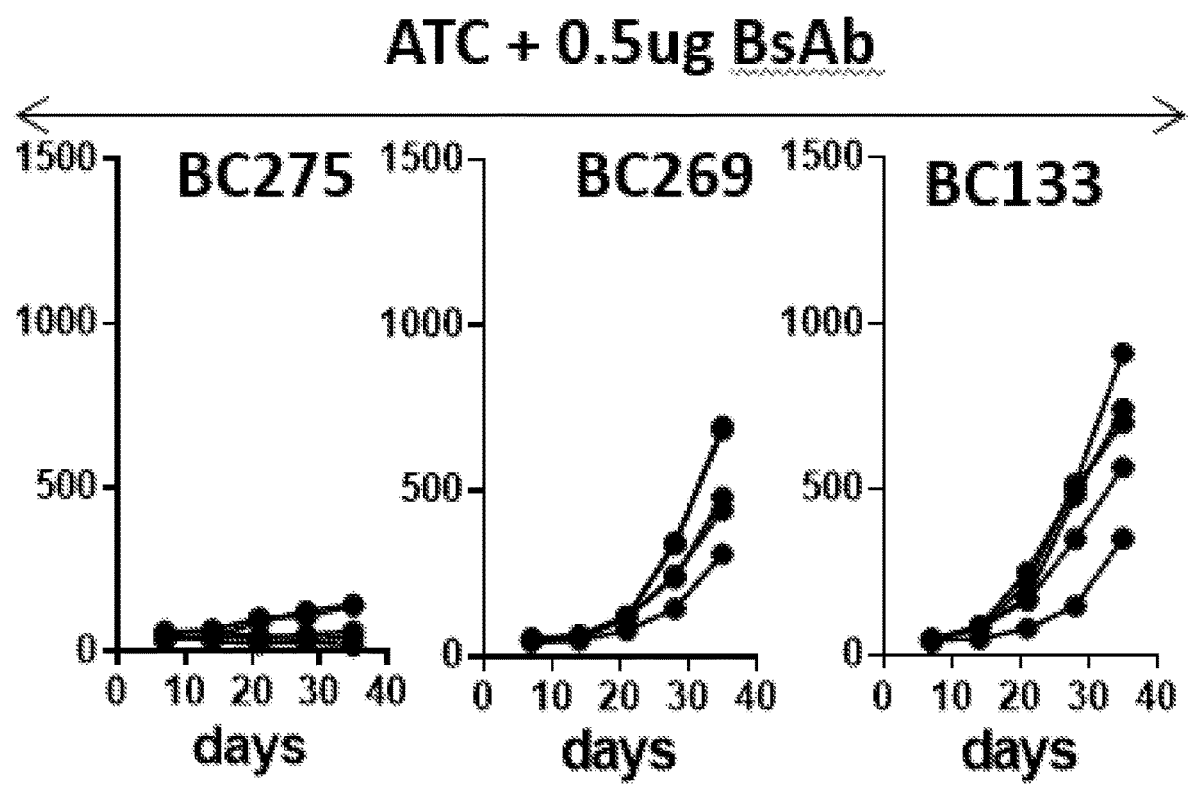
Figure 25D:
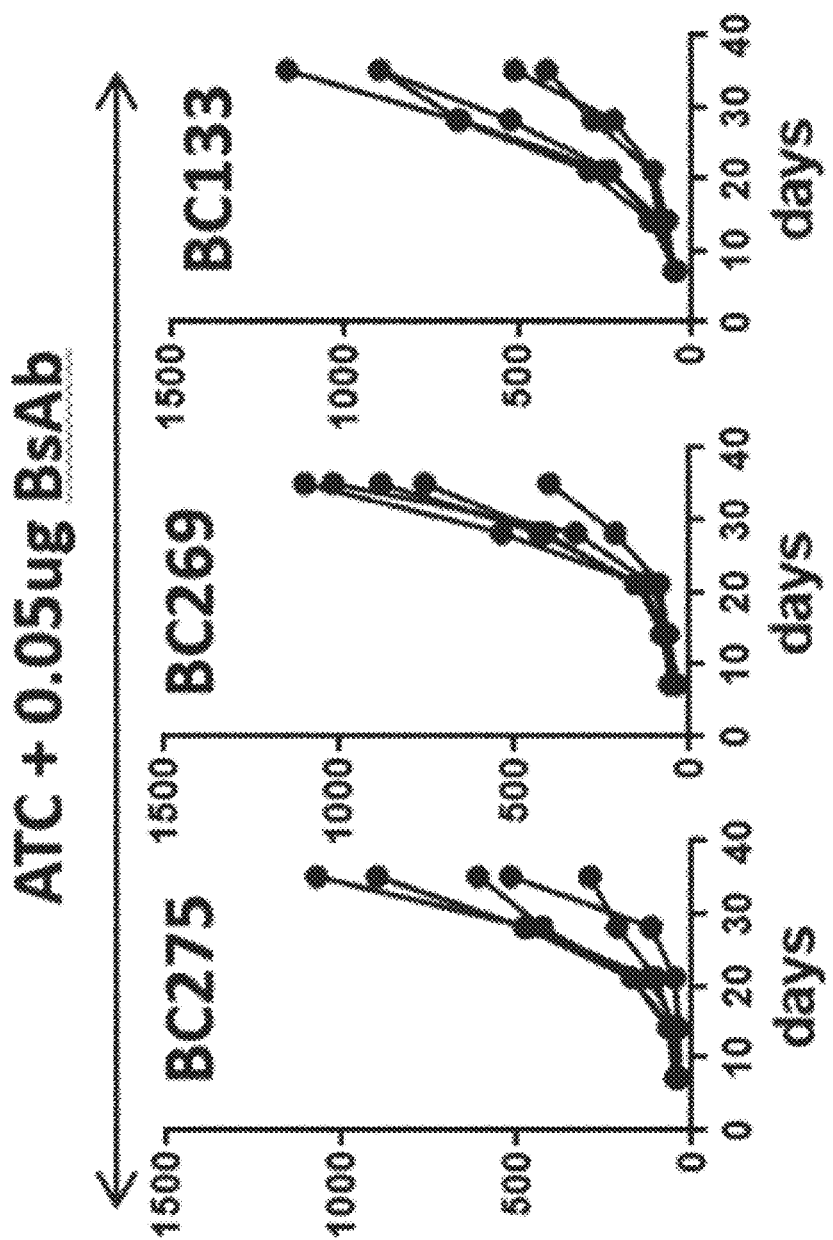

Animal experiments were performed on immunodeficient DKO mice that were subcutaneously inoculated with K562 human leukemia xenografts (which has the TT genotype for the rs12459419 SNP). Therapy was initiated after 7 days (FIGS. 25(A)-25(D)). Mice received three injections ($10^7$, one-week interval between the doses) of activated T-cells with 0.05 µg or 0.5 µg BsAb µg/kg/dose or 20 µg/kg/dose). In the control group, mice received T-cells plus BC119 (CD3×GD2 BsAb). The timing of T cell and antibody injections are shown in FIG. 25(A). Leukemia progression was monitored by measuring tumor size. To support T cell engraftment, all mice received 2 subcutaneous injections of interleukin-2 (1000 IU) per week during the first three weeks of T cell injections. The most potent BsAb was BC275 (the CD33 antibody of the present technology) which showed the highest degree of tumor reduction compared with the conventional BC269 and BC133 BsAbs (i.e., BC275>BC269>BC133).

Accordingly, the immunoglobulin-related compositions disclosed herein are useful for detecting and treating a CD33-associated cancer in a subject in need thereof.

Example 5: Use of Anti-CD33 BsAb of the Present Technology in PRIT

IgG-based CD33-C825 BsAbs. CD33(+) leukemic cells will be injected subcutaneously, intraperitoneally, intravenously, or via other routes into animals. After tumor establishment (depending on the type of tumor and the route of injection), treatment will be initiated. Treatment is composed of one or more cycles. Each cycle comprises administration of the test BsAb (250 µg intravenously), followed by injection of a clearing agent (DOTA dextran or DOTA dendrimer; dose is 5-15% of the BsAb dose, see Cheal S M et al., *Mol Cancer Ther* 13:1803-12, 2014) after 24 to 48 hours. After 4 hours, DOTA-$^{177}$Lu (up to 1.5 mCi) or DOTA-$^{225}$Ac (1 µCi) will be injected intravenously. Generally, DOTA-$^{225}$Ac is more potent than DOTA-$^{177}$Lu and may require fewer cycles for tumor eradication.

Tetramerized BsAbs. CD33(+) leukemic cells will be injected subcutaneously, intraperitoneally, intravenously, or via other routes into animals and after tumor establishment (depending on the type of tumor and the route of injection), treatment will be initiated. Treatment is composed of one or more cycles. Each cycle consists of administration of the BsAb (250 µg intravenously) followed by intravenous injection of DOTA-$^{177}$Lu (up to 1.5 mCi) or DOTA-$^{225}$Ac (1 µCi) after 24-48 hours. Generally, DOTA-$^{225}$Ac is more potent than DOTA-$^{177}$Lu and may require fewer cycles for tumor eradication.

These results demonstrate that the antibodies or antigen binding fragments of the present technology can detect tumors and inhibit the progression of tumor growth and/or metastasis. Accordingly, the immunoglobulin-related compositions disclosed herein are useful for detecting and treating a CD33-associated cancer in a subject in need thereof.

Example 6: Use of Anti-CD33 BsAb of the Present Technology in Treating Alzheimer's Disease Various rodent models for Alzheimer's Disease (AD) have been developed (Nazem et al., *J Neuroinflammation* 17; 12:74 (2015)). Since the HIM34 antibody binds human CD33 and does not cross react with mouse CD33, a knocked-in mouse model of human CD33 (hCD33) will be generated. The hCD33 mice will then be crossed with the Alzheimer's disease transgenic mice in Nazem et al. (2015), and the progenies will be used for studying the therapeutic effects of the CD33 antibodies or antigen binding fragments of the present technology in vivo.

In one experiment, an anti-CD33 BsAb disclosed herein including the C825 anti-DOTA binding moiety will be injected intracranially or into the cerebrospinal fluid followed by intravenous injection of the radiolabeled metal-DOTA conjugate for example $^{177}$Lu-DOTA-Bn. Histopathologic assessment of brain tissue over time in addition to the behavioral analysis of mice will be used for outcome measurement. It is anticipated that animals receiving an anti-CD33 BsAb of the present technology will show amelioration in one or more symptoms of Alzheimer's Disease (AD) compared to that observed in untreated controls.

Accordingly, the immunoglobulin-related compositions disclosed herein are useful for treating Alzheimer's disease in a subject in need thereof.

EQUIVALENTS

The present technology is not to be limited in terms of the particular embodiments described in this application, which are intended as single illustrations of individual aspects of the present technology. Many modifications and variations of this present technology can be made without departing from its spirit and scope, as will be apparent to those skilled in the art. Functionally equivalent methods and apparatuses within the scope of the present technology, in addition to those enumerated herein, will be apparent to those skilled in the art from the foregoing descriptions. Such modifications and variations are intended to fall within the scope of the present technology. It is to be understood that this present technology is not limited to particular methods, reagents, compounds compositions or biological systems, which can, of course, vary. It is also to be understood that the terminology used herein is for the purpose of describing particular embodiments only, and is not intended to be limiting.

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, particularly in terms of providing a written description, all ranges disclosed herein also encompass any and all possible subranges and combinations of subranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like, include the number recited and refer to ranges which can be subsequently broken down into subranges as discussed above. Finally, as will be understood by one skilled in the art, a range includes each individual member. Thus, for example, a group having 1-3 cells refers to groups having 1, 2, or 3 cells. Similarly, a group having 1-5 cells refers to groups having 1, 2, 3, 4, or 5 cells, and so forth.

All patents, patent applications, provisional applications, and publications referred to or cited herein are incorporated by reference in their entirety, including all figures and tables, to the extent they are not inconsistent with the explicit teachings of this specification.

SEQUENCE LISTING (167 sequences)

SEQ ID NO: 1 - protein, 119 aa, Artificial Sequence
  Description of Artificial Sequence: Synthetic polypeptide
EVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSS

SEQ ID NO: 2 - protein, 119 aa, Artificial Sequence
  Description of Artificial Sequence: Synthetic polypeptide
QVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSS

SEQ ID NO: 3 - protein, 119 aa, Artificial Sequence
  Description of Artificial Sequence: Synthetic polypeptide
EVQLQQSGAEVKKPGASVKVSCKASGYSFTDYNMYWVRQAPGQGLEWIGYIDPYKGGTNYAQKFQGRATMTVDKSSSTAYMELSRLRSDDTAVYYCAREMITAYYFDYWGQGSSVTVSS

SEQ ID NO: 4 - protein, 119 aa, Artificial Sequence
  Description of Artificial Sequence: Synthetic polypeptide
EVQLQQSGAEVKKPGASVKVSCKASGYSFTDYNMYWVRQAPGQGLEWIGYIDPYKGGTNYAQKFQGRVTLTRDKSISTAYMELSRLRSDDTAVYYCAREMITAYYFDYWGQGSSVTVSS

SEQ ID NO: 5 - protein, 119 aa, Artificial Sequence
  Description of Artificial Sequence: Synthetic polypeptide
QVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSS

SEQ ID NO: 6 - protein, 119 aa, Artificial Sequence
  Description of Artificial Sequence: Synthetic polypeptide
QVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSS

SEQ ID NO: 7 - protein, 119 aa, Artificial Sequence
  Description of Artificial Sequence: Synthetic polypeptide
QVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSS

SEQ ID NO: 8 - protein, 106 aa, Artificial Sequence
  Description of Artificial Sequence: Synthetic polypeptide
DIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELK

SEQ ID NO: 9 - protein, 106 aa, Artificial Sequence
  Description of Artificial Sequence: Synthetic polypeptide
DIQMTQSPSSLSASVGDRVTITCKASQDINKYLNWYQQKPGKAPKLLIHYTSTLQPGIPSRFSGSGSGTDFTFTISSLQPEDIATYYCLQYDNLLTFGAGTKLELK

SEQ ID NO: 10 - protein, 106 aa, Artificial Sequence
  Description of Artificial Sequence: Synthetic polypeptide
DIQMTQSPSSLSASVGDRVTITCKASQDINKYLNWYQQKPGKAPKLLIYYTSTLQPGIPSRFSGSGSGRDFTFTISSLQPEDIATYYCLQYDNLLTFGAGTKLELK

SEQ ID NO: 11 - protein, 106 aa, Artificial Sequence
  Description of Artificial Sequence: Synthetic polypeptide
DIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELK

SEQ ID NO: 12 - protein, 106 aa, Artificial Sequence
  Description of Artificial Sequence: Synthetic polypeptide
DIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELK

SEQ ID NO: 13 - protein, 106 aa, Artificial Sequence
  Description of Artificial Sequence: Synthetic polypeptide
DIQMTQSPSSLSASVGDRVTITCKASQDINKYIAWYQQKPGKAPKLLIYYTSTLQPGVPSRFSGSGSGTDFTFTISSLQPEDIATYYCLQYDNLLTFGAGTKLELK

SEQ ID NO: 14 - protein, 505 aa, Artificial Sequence
  Description of Artificial Sequence: Synthetic polypeptide
MGWSCIILFLVATATGVHSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTSGGGGSGGGGSGGGGSQVQLVQSGGGVVQPGRSLRLSCKASGYTFTRYTMHWVRQAPGKCLEWIGYINPSRGYTNYNQKFKDRFTISRDNSKNTAFLQMDSLRPEDTGVYFCARYYDDHYSLDYWGQGTPVTVSSGGGGSGGGGSGGGGSGGGGSGGGGSGGGGSDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGCGTKLQITR

SEQ ID NO: 15 - DNA, 1518 bp, Artificial Sequence
  Description of Artificial Sequence: Synthetic polynucleotide
atgggctggtcctgcatcatcctgttcctggtggccaccgccaccggcgtgcacagcgacatcgtcatgactcagagccctagcagcctgagcgcatccctgggaggaaaggtcactatcacttgtaaagcatcacaggacatcaacaagtacatcgcctggtatcagcacaagccaggcaaaggcccccggctgctgatccactacaccagcacactgcagccaggcatcccttcccggttcagcggctccggctctggaagagactacagcttttccatctctaatctggagcccgaggatatcgccacctattattgtctgcagtatgataatctgctgacatttggcgctggaactaagctggaactgaaacggaccgtggccgccccctccgtgttcatcttccccccctccgacgagcagctgaagtccggcaccgcctccgtggtgtgcctgctgaacaacttctacccccgggaggccaaggtgcagtggaaggtggacaacgccctgcagtccggcaactcccaggagtccgtgaccgagcaggactccaaggactccacctactccctgtcctccaccctgaccctgtccaaggccgactacgagaagcacaaggtgtacgcctgcgaggtgacccaccagggcctgtcctcccccgtgaccaagtccttcaaccggggcgagtgcactagtggcggcggaggatctggcggaggtggaagcggagggggaggatctcaggtgcagctggtgcagagcggaggcggagtggtgcagcctggcagatccctgagactgtcctgcaaggcctccggctacaccttcacccggtacaccatgcactgggtgcgacaggcccctggcaagtgcctggaatggatcggctacatcaacccctcccggggctacaccaactacaaccagaagttcaaggaccggttcaccatctcccgggacaactccaagaacaccgcctttctgcagatggactccctgcggcctgaggataccggcgtgtacttctgcgcccggtactacgacgaccactactccctggactactggggccagggaacccctgtgacagtgtcatctggtggcggaggaagtgggggaggcggatcaggtggtggtggatcaggcgggggaggttcagggggtggcggttctgggggagggggctctgatattcagatgactcagagcccttccagcctgagcgcctccgtgggagatcgcgtgacaattacctgctctgcctcctcctccgtgtcttacatgaattggtatcagcagacccctgggaaggctcctaagcggtggatctacgacacctccaagctggcctctggcgtgcccagcaggttttctggctccggcagcggcacagattataccttcaccatcagctccctgcagccagaagatatcgctacctattattgtcagcagtggtcctccaaccctttcaccttcggctgcggcacaaagctgcagatcacaagatag

SEQ ID NO: 16 - protein, 468 aa, Artificial Sequence
  Description of Artificial Sequence: Synthetic polypeptide
MGWSCIILFLVATATGVHSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - DNA, 1407 bp, Artificial Sequence
  Description of Artificial Sequence: Synthetic polynucleotide
atgggctggtcctgcatcatcctgttcctggtggccaccgccaccggcgtgcacagcgaagtgaaactgcagcagagcggccctgaactggtcaaacctggaacctccgtgaaagtgtcttgtaaagcatccgggtactcattcaccgactacaacatgtattgggtgaagcagagccacggcaagtccctggagtggatcggctacatcgacccctataagggcggcacaatctacaaccagaagttcaagggcaaggccaccctgacagtggacaagagctcctctaccgcctttatgcacctgaatagcctgacatccgaggattctgccgtgtactattgcgcccgggagatgattacagcctactactttgattactggggacaggggtcttccgtcaccgtctcctctgcctccaccaagggcccctctgtgtttcctctggccccctccagcaagtccacctctggtggaacagccgccctgggctgcctcgtgaaggactactttcccgagcccgtgaccgtgtcctggaactctggcgctctgacctctggcgtgcacaccttccctgctgtgctgcagtctagcggcctgtactccctgtcctccgtcgtgacagtgccctccagctctctgggcacccagacctacatctgcaacgtgaaccacaagccctccaataccaaggtggacaagcgggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacgcctccacctaccgggtggtgtccgtgctgacagtgctgcaccaggactggctgaacggcaaagagtacaagtgcgccgtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgaccgtggacaagtcccggtggcagcagggcaacgtgttctcctgctccgtgatgcacgaggccctgcacaaccactacacccagaagtccctgtccctgagccccggcaaatga

SEQ ID NO: 18 - protein, 505 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTSGGGGSGGGGSGGGGSQVQLVQSGGGVVQPGRSLRLSCKASGYTFTRYTMHWVRQAPGKCLEWIGYINPSRGYTNYNQKFKDRFTISRDNSKNTAFLQMDSLRPEDTGVYFCARYYDDHYSLDYWGQGTPVTVSSGGGGSGGGGSGGGGSGGGGSGGGGSGGGGSDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGCGTKLQITR

SEQ ID NO: 19 - DNA, 1518 bp, Artificial Sequence
  Description of Artificial Sequence: Synthetic polynucleotide
atgggctggtcctgcatcatcctgttcctggtggccaccgccaccggcgtgcacagcgacatccagatgacccagtccccaagctccctgtccgcctctgtgggcgaccgggtgaccatcacatgcaaggcctcccaggatatcaacaagtacatcgcctggtatcagcacaagcccggcaaggcccctaagctgctgatccactacacctctacactggagaccggcgtgccaagcagattcagcggctccggctctggcacagatttcacctttacaatctctagcctgcagcccgaggacatcgccacatactattgtctgcagtatgataatctgctgacctttggcgccggcacaaagctggagctgaagcggaccgtggccgccccctccgtgttcatcttccccccctccgacgagcagctgaagtccggcaccgcctccgtggtgtgcctgctgaacaacttctacccccgggaggccaaggtgcagtggaaggtggacaacgccctgcagtccggcaactcccaggagtccgtgaccgagcaggactccaaggactccacctactccctgtcctccaccctgaccctgtccaaggccgactacgagaagcacaaggtgtacgcctgcgaggtgacccaccagggcctgtcctcccccgtgaccaagtccttcaaccggggcgagtgcactagtggcggcggaggatctggcggaggtggaagcggagggggaggatctcaggtgcagctggtgcagagcggaggcggagtggtgcagcctggcagatccctgagactgtcctgcaaggcctccggctacaccttcacccggtacaccatgcactgggtgcgacaggcccctggcaagtgcctggaatggatcggctacatcaacccctcccggggctacaccaactacaaccagaagttcaaggaccggttcaccatctcccgggacaactccaagaacaccgcctttctgcagatggactccctgcggcctgaggataccggcgtgtacttctgcgcccggtactacgacgaccactactccctggactactggggccagggaacccctgtgacagtgtcatctggtggcggaggaagtgggggaggcggatcaggtggtggtggatcaggcgggggaggttcagggggtggcggttctgggggagggggctctgatattcagatgactcagagcccttccagcctgagcgcctccgtgggagatcgcgtgacaattacctgctctgcctcctcctccgtgtcttacatgaattggtatcagcagacccctgggaaggctcctaagcggtggatctacgacacctccaagctggcctctggcgtgcccagcaggttttctggctccggcagcggcacagattataccttcaccatcagctccctgcagccagaagatatcgctacctattattgtcagcagtggtcctccaaccctttcaccttcggctgcggcacaaagctgcagatcacaagatag

SEQ ID NO: 20 - protein, 468 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - DNA, 1407 bp, Artificial Sequence
  Description of Artificial Sequence: Synthetic polynucleotide
atgggctggtcctgcatcatcctgttcctggtggccaccgccaccggcgtgcacagccaggtgcagctgcagcagtccggagcagaggtggtgaagccaggagcctctgtgaaggtgagctgcaaggccagcggctactccttcaccgactacaacatgtattgggtgcggcaggcaccaggacagggcctggagtggatgggctacatcgacccttataagggcggcacaatctacaatcagaagtttcagggaagggccaccctgacaagggacacctccatctctacagcctatatggagctgtcccggctgagatctgacgataccgccgtgtactattgtgccagggagatgatcacagcctactatttcgattattggggccagggcagctccgtgaccgtgtctagcgcctccaccaagggcccctctgtgtttcctctggccccctccagcaagtccacctctggtggaacagccgccctgggctgcctcgtgaaggactactttcccgagcccgtgaccgtgtcctggaactctggcgctctgacctctggcgtgcacaccttccctgctgtgctgcagtctagcggcctgtactccctgtcctccgtcgtgacagtgccctccagctctctgggcacccagacctacatctgcaacgtgaaccacaagccctccaataccaaggtggacaagcgggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacgcctccacctaccgggtggtgtccgtgctgacagtgctgcaccaggactggctgaacggcaaagagtacaagtgcgccgtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgaccgtggacaagtcccggtggcagcagggcaacgtgttctcctgctccgtgatgcacgaggccctgcacaaccactacacccagaagtccctgtccctgagccccggcaaatga

SEQ ID NO: 22 - protein, 468 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - DNA, 1407 bp, Artificial Sequence
  Description of Artificial Sequence: Synthetic polynucleotide
atgggctggtcctgcatcatcctgttcctggtggccaccgccaccggcgtgcacagccaggtgcagctgcagcagtccggagcagaggtgaagaagccaggagcctctgtgaaggtgagctgcaaggccagcggctactccttcaccgactacaacatgtattgggtgcggcaggcaccaggacagggcctggagtggatgggctacatcgacccttataagggcggcacaatctacaatcagaagtttaagggaagggccaccctgacaagggacacctccatctctacagcctatatggagctgtcccggctgagatctgacgataccgccgtgtactattgtgccagggagatgatcacagcctactatttcgattattggggccagggcagctccgtgaccgtgtctagcgcctccaccaagggcccctctgtgtttcctctggccccctccagcaagtccacctctggtggaacagccgccctgggctgcctcgtgaaggactactttcccgagcccgtgaccgtgtcctggaactctggcgctctgacctctggcgtgcacaccttccctgctgtgctgcagtctagcggcctgtactccctgtcctccgtcgtgacagtgccctccagctctctgggcacccagacctacatctgcaacgtgaaccacaagccctccaataccaaggtggacaagcgggtggaacccaagtcctgcgacaagacccacacctgtcccccttgtcctgcccctgaactgctgggcggaccttccgtgttcctgttccccccaaagcccaaggacaccctgatgatctcccggacccccgaagtgacctgcgtggtggtggatgtgtcccacgaggaccctgaagtgaagttcaattggtacgtggacggcgtggaagtgcacaacgccaagaccaagcctagagaggaacagtacgcctccacctaccgggtggtgtccgtgctgacagtgctgcaccaggactggctgaacggcaaagagtacaagtgcgccgtgtccaacaaggccctgcctgcccccatcgaaaagaccatctccaaggccaagggccagccccgggaaccccaggtgtacacactgccccctagcagggacgagctgaccaagaaccaggtgtccctgacctgtctcgtgaaaggcttctacccctccgatatcgccgtggaatgggagtccaacggccagcctgagaacaactacaagaccaccccccctgtgctggactccgacggctcattcttcctgtacagcaagctgaccgtggacaagtcccggtggcagcagggcaacgtgttctcctgctccgtgatgcacgaggccctgcacaaccactacacccagaagtccctgtccctgagccccggcaaatga

SEQ ID NO: 24 - protein, 505 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTSGGGGSGGGGSGGGGSQVQLVQSGGGVVQPGRSLRLSCKASGYTFTRYTMHWVRQAPGKCLEWIGYINPSRGYTNYNQKFKDRFTISRDNSKNTAFLQMDSLRPEDTGVYFCARYYDDHYSLDYWGQGTPVTVSSGGGGSGGGGSGGGGSGGGGSGGGGSGGGGSDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGCGTKLQITR

SEQ ID NO: 25 - DNA, 1518 bp, Artificial Sequence
  Description of Artificial Sequence: Synthetic polynucleotide
atgggctggtcctgcatcatcctgttcctggtggccaccgccaccggcgtgcacagcgacatccagatgacccagtcccctagctccctgtccgcctctgtgggcgacagggtgaccatcacatgcaaggcctcccaggatatcaacaagtacatcgcctggtatcagcacaagccaggcaaggcccccaagctgctgatctactatgcctctaatctgcagccaggagtgcctagccggttcagcggctccggctctggaagagatttcacctttacaatctctagcctgcagcccgaggacatcgccacatactattgtctgcagtacgataacctgctgacctttggcgccggcacaaagctggagctgaagcggaccgtggccgccccctccgtgttcatcttccccccctccgacgagcagctgaagtccggcaccgcctccgtggtgtgcctgctgaacaacttctacccccgggaggccaaggtgcagtggaaggtggacaacgccctgcagtccggcaactcccaggagtccgtgaccgagcaggactccaaggactccacctactccctgtcctccaccctgaccctgtccaaggccgactacgagaagcacaaggtgtacgcctgcgaggtgacccaccagggcctgtcctcccccgtgaccaagtccttcaaccggggcgagtgcactagtggcggcggaggatctggcggaggtggaagcggagggggaggatctcaggtgcagctggtgcagagcggaggcggagtggtgcagcctggcagatccctgagactgtcctgcaaggcctccggctacaccttcacccggtacaccatgcactgggtgcgacaggcccctggcaagtgcctggaatggatcggctacatcaacccctcccggggctacaccaactacaaccagaagttcaaggaccggttcaccatctcccgggacaactccaagaacaccgcctttctgcagatggactccctgcggcctgaggataccggcgtgtacttctgcgcccggtactacgacgaccactactccctggactactggggccagggaacccctgtgacagtgtcatctggtggcggaggaagtgggggaggcggatcaggtggtggtggatcaggcgggggaggttcagggggtggcggttctgggggagggggctctgatattcagatgactcagagcccttccagcctgagcgcctccgtgggagatcgcgtgacaattacctgctctgcctcctcctccgtgtcttacatgaattggtatcagcagacccctgggaaggctcctaagcggtggatctacgacacctccaagctggcctctggcgtgcccagcaggttttctggctccggcagcggcacagattataccttcaccatcagctccctgcagccagaagatatcgctacctattattgtcagcagtggtcctccaaccctttcaccttcggctgcggcacaaagctgcagatcacaagatag

SEQ ID NO: 26 - protein, 508 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTSGGGGSGGGGSGGGGSHVKLQESGPGLVQPSQSLSLTCTVSGFSLTDYGVHWVRQSPGKGLEWLGVIWSGGGTAYNTALISRLNIYRDNSKNQVFLEMNSLQAEDTAMYYCARRGSYPYNYFDAWGCGTTVTVSSGGGGSGGGGSGGGGSGGGGSGGGGSGGGGSQAVVIQESALTTPPGETVTLTCGSSTGAVTASNYANWVQEKPDHCFTGLIGGHNNRPPGVPARFSGSLIGDKAALTIAGTQTEDEAIYFCALWYSDHWVIGGGTRLTVLG

SEQ ID NO: 27 - protein, 508 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLG

SEQ ID NO: 28 - protein, 508 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTSGGGGSGGGGSGGGGSHVKLQESGPGLVQPSQSLSLTCTVSGFSLTDYGVHWVRQSPGKGLEWLGVIWSGGGTAYNTALISRLNIYRDNSKNQVFLEMNSLQAEDTAMYYCARRGSYPYNYFDAWGCGTTVTVSSGGGGSGGGGSGGGGSGGGGSGGGGSGGGGSQAVVIQESALTTPPGETVTLTCGSSTGAVTASNYANWVQEKPDHCFTGLIGGHNNRPPGVPARFSGSLIGDKAALTIAGTQTEDEAIYFCALWYSDHWVIGGGTRLTVLG

SEQ ID NO: 29 - protein, 508 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLG

SEQ ID NO: 30 - protein, 617 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 31 - protein, 610 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 32 - protein, 617 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 33 - protein, 610 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 34 - protein, 635 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 35 - protein, 628 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 36 - protein, 635 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 37 - protein, 628 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 38 - protein, 630 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 39 - protein, 623 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 40 - protein, 630 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 41 - protein, 623 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 42 - protein, 617 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 43 - protein, 610 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 44 - protein, 617 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 45 - protein, 610 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 46 - protein, 635 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 47 - protein, 628 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 48 - protein, 635 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 49 - protein, 628 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 50 - protein, 630 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 51 - protein, 623 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 52 - protein, 630 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 53 - protein, 623 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 54 - protein, 617 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 55 - protein, 610 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 56 - protein, 617 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 57 - protein, 610 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 58 - protein, 635 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 59 - protein, 628 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 60 - protein, 635 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 61 - protein, 628 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 62 - protein, 630 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 63 - protein, 623 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 64 - protein, 630 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 65 - protein, 623 aa, Artificial Sequence
  Description of Artificial Sequence: Synthetic polypeptide
MGWSCIILFLVATATGVHSQVQLQQSGAEVKKPGASVKVSCKASGYSFTDYNMYWVRQAPGQGLEWMGYIDPYKGGTIYNQKFKGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 66 - protein, 617 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 67 - protein, 610 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 68 - protein, 617 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 69 - protein, 610 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 70 - protein, 635 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 71 - protein, 628 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 72 - protein, 635 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 73 - protein, 628 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 74 - protein, 630 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 75 - protein, 623 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 76 - protein, 630 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 77 - protein, 623 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 78 - protein, 617 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 79 - protein, 610 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 80 - protein, 617 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 81 - protein, 610 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 82 - protein, 635 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 83 - protein, 628 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 84 - protein, 635 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 85 - protein, 628 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 86 - protein, 630 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 87 - protein, 623 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 88 - protein, 630 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 89 - protein, 623 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWIGYIDPYKGGTNYAQKFQGRVTMTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 90 - protein, 617 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 91 - protein, 610 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 92 - protein, 617 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 93 - protein, 610 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 94 - protein, 635 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 95 - protein, 628 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 96 - protein, 635 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 97 - protein, 628 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 98 - protein, 630 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 99 - protein, 623 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSGGGGSGGGGSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 100 - protein, 630 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 101 - protein, 623 aa, Artificial Sequence
  Description of Artificial Sequence: Synthetic polypeptide
MGWSCIILFLVATATGVHSQVQLQQSGAEVVKPGASVKVSCKASGYSFTDYNMYWVRQAPGQGLEWMGYIDPYKGGTIYNQKFQGRATLTRDTSISTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIYYASNLQPGVPSRFSGSGSGRDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 102 - protein, 617 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 103 - protein, 610 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 104 - protein, 617 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 105 - protein, 610 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 106 - protein, 635 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 107 - protein, 628 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 108 - protein, 635 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 109 - protein, 628 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 110 - protein, 630 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 111 - protein, 623 aa, Artificial Sequence
  Description of Artificial Sequence: Synthetic polypeptide
MGWSCIILFLVATATGVHSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSGGGGSGGGGSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 112 - protein, 630 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 113 - protein, 623 aa, Artificial Sequence
  Description of Artificial Sequence: Synthetic polypeptide
MGWSCIILFLVATATGVHSQVQLVQSGAEVKKPGASVKVSCKASGYSFTDYNMYWVRQAPGQGLEWIGYIDPYKGGTNYAQKFQGRATLTVDKSSSTAYMELSRLRSDDTAVYYCAREMITAYYFDYWGQGSSVTVSSGGGGSGGGGSGGGGSGGGGSGGGGSGGGGSDIQMTQSPSSLSASVGDRVTITCKASQDINKYIAWYQHKPGKAPKLLIHYTSTLETGVPSRFSGSGSGTDFTFTISSLQPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 114 - protein, 119 aa, Artificial Sequence; identical to SEQ ID NO: 1
  Description of Artificial Sequence: Synthetic polypeptide

SEQ ID NO: 115 - protein, 106 aa, Artificial Sequence; identical to SEQ ID NO: 8
  Description of Artificial Sequence: Synthetic polypeptide

SEQ ID NO: 116 - protein, 384 aa, Homo sapiens
APTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDHGPMK

SEQ ID NO: 117 - protein, 330 aa, Homo sapiens [sequence omitted]

SEQ ID NO: 118 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 119 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 120 - protein, 452 aa, Homo sapiens
GSASAPTLFPLVSCENSPSDTSSVAVGCLAQDFLPDSITLSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVAHEALPNRVTERTVDKSTGKPTLYNVSLVMSDTAGTCY

SEQ ID NO: 121 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 122 - protein, 353 aa, Homo sapiens
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 123 - protein, 340 aa, Homo sapiens
ASPTSPKVFPLSLDSTPQDGNVVVACLVQGFFPQEPLSVTWSESGQNVTARNFPPSQDASGDLYTTSSQLTLPATQCPDGKSVTCHVKHYTNPSQDVTVPCPVPPPPPCCHPRLSLHRPALEDLLLGSEANLTCTLTGLRDASGATFTWTPSSGKSAVQGPPERDLCGCYSVSSVLPGCAQPWNHGETFTCTAAHPELKTPLTANITKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRMAGKPTHVNVSVVMAEVDGTCY

SEQ ID NO: 124 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 125 - protein, 39 aa, Homo sapiens
KPLDGEYFTLQIRGRERFEMFRELNEALELKDAQAGKEP

SEQ ID NO: 126 - protein, 57 aa, Homo sapiens
RSPDDELLYLPVRGRETYEMLLKIKESLELMQYLPQHTIETYRQQQQQQHQHLLQKQ

SEQ ID NO: 127 - protein, 52 aa, Homo sapiens
RHGDEDTYYLQVRGRENFEILMKLKESLELMELVPQPLVDSYRQQQQLLQRP

SEQ ID NO: 128 - protein, 27 aa, Homo sapiens
QAIKKELTQIKQKVDSLLENLEKIEKE

SEQ ID NO: 129 - protein, 54 aa, Homo sapiens
STRRILGLAIESQDAGIKTITMLDEQKEQLNRIEEGLDQINKDMRETEKTLTEL

SEQ ID NO: 130 - protein, 97 aa, Homo sapiens [sequence omitted]

SEQ ID NO: 131 - protein, 30 aa, Unknown
  Description of Unknown: KCNQ4 sequence
DEISMMGRVVKVEKQVQSIEHKLDLLLGFY

SEQ ID NO: 132 - protein, 60 aa, Unknown
  Description of Unknown: CBFA2T1 sequence
TVAEAKRQAAEDALAVINQQEDSSESCWNCGRKASETCSGCNTARYCGSFCQHKDWEKHH

SEQ ID NO: 133 - protein, 119 aa, Artificial Sequence
  Description of Artificial Sequence: Synthetic polypeptide
QVQLQQSGAEVKKPGASVKVSCKASGYSFTDYNMYWVRQAPGQGLEWIGYIDPYKGGTIYNQKFKGRATLTRDTSISTAYMELSRLRSDDTAVYYCAREMITAYYFDYWGQGSSVTVSS

SEQ ID NO: 134 - protein, 505 aa, Artificial Sequence; identical to SEQ ID NO: 24
  Description of Artificial Sequence: Synthetic polypeptide

SEQ ID NO: 135 - DNA, 1518 bp, Artificial Sequence; identical to SEQ ID NO: 25
  Description of Artificial Sequence: Synthetic polynucleotide

SEQ ID NO: 136 - protein, 468 aa, Artificial Sequence; identical to SEQ ID NO: 20
  Description of Artificial Sequence: Synthetic polypeptide

SEQ ID NO: 137 - DNA, 1407 bp, Artificial Sequence; identical to SEQ ID NO: 21
  Description of Artificial Sequence: Synthetic polynucleotide

SEQ ID NO: 138 - protein, 508 aa, Artificial Sequence
  Description of Artificial Sequence: Synthetic polypeptide
MGWSCIILFLVATATGVHSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTSGGGGSGGGGSGGGGSHVKLQESGPGLVQPSQSLSLTCTVSGFSLTDYGVHWVRQSPGKGLEWLGVIWSGGGTAYNTALISRLNIYRDNSKNQVFLEMNSLQAEDTAMYYCARRGSYPYNYFDAWGCGTTVTVSSGGGGSGGGGSGGGGSGGGGSGGGGSGGGGSQAVVIQESALTTPPGETVTLTCGSSTGAVTASNYANWVQEKPDHCFTGLIGGHNNRPPGVPARFSGSLIGDKAALTIAGTQTEDEAIYFCALWYSDHWVIGGGTRLTVLG

SEQ ID NO: 139 - protein, 468 aa, Artificial Sequence; identical to SEQ ID NO: 16
  Description of Artificial Sequence: Synthetic polypeptide

SEQ ID NO: 140 - protein, 508 aa, Artificial Sequence
  Description of Artificial Sequence: Synthetic polypeptide
MGWSCIILFLVATATGVHSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLG

SEQ ID NO: 141 - protein, 468 aa, Artificial Sequence; identical to SEQ ID NO: 16
  Description of Artificial Sequence: Synthetic polypeptide

SEQ ID NO: 142 - protein, 617 aa, Artificial Sequence
  Description of Artificial Sequence: Synthetic polypeptide
MGWSCIILFLVATATGVHSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 143 - protein, 610 aa, Artificial Sequence
  Description of Artificial Sequence: Synthetic polypeptide
MGWSCIILFLVATATGVHSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 144 - protein, 617 aa, Artificial Sequence
  Description of Artificial Sequence: Synthetic polypeptide
MGWSCIILFLVATATGVHSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSGGGGSGGGGSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGAPHHHHHH

SEQ ID NO: 145 - protein, 610 aa, Artificial Sequence
  Description of Artificial Sequence: Synthetic polypeptide
MGWSCIILFLVATATGVHSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSGGGGSGGGGSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGKPLDGEYFTLQIRGRERFEMFRELNEALELKDAQAGKEPGGSGGA

SEQ ID NO: 146 - protein, 635 aa, Artificial Sequence
  Description of Artificial Sequence: Synthetic polypeptide
MGWSCIILFLVATATGVHSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 147 - protein, 628 aa, Artificial Sequence
  Description of Artificial Sequence: Synthetic polypeptide
MGWSCIILFLVATATGVHSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 148 - protein, 635 aa, Artificial Sequence
  Description of Artificial Sequence: Synthetic polypeptide
MGWSCIILFLVATATGVHSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSGGGGSGGGGSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGAPHHHHHH

SEQ ID NO: 149 - protein, 628 aa, Artificial Sequence
  Description of Artificial Sequence: Synthetic polypeptide
MGWSCIILFLVATATGVHSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSGGGGSGGGGSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRSPDDELLYLPVRGRETYEMLLKIKESLELMQYLPQHTIETYRQQQQQQHQHLLQKQGGSGGA

SEQ ID NO: 150 - protein, 630 aa, Artificial Sequence
  Description of Artificial Sequence: Synthetic polypeptide
MGWSCIILFLVATATGVHSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 151 - protein, 623 aa, Artificial Sequence
  Description of Artificial Sequence: Synthetic polypeptide
MGWSCIILFLVATATGVHSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 152 - protein, 630 aa, Artificial Sequence
  Description of Artificial Sequence: Synthetic polypeptide
MGWSCIILFLVATATGVHSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSGGGGSGGGGSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGAPHHHHHH

SEQ ID NO: 153 - protein, 623 aa, Artificial Sequence
  Description of Artificial Sequence: Synthetic polypeptide
MGWSCIILFLVATATGVHSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSGGGGSGGGGSGGGGSGGGGSGGGGSGGGGSDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSGGGGSHVQLVESGGGLVQPGGSLRLSCAASGFSLTDYGVHWVRQAPGKGLEWLGVIWSGGGTAYNTALISRFTISRDNSKNTLYLQMNSLRAEDTAVYYCARRGSYPYNYFDAWGCGTLVTVSSGGGGSGGGGSGGGGSGGGGSGGGGSGGGGSQAVVTQEPSLTVSPGGTVTLTCGSSTGAVTASNYANWVQQKPGQCPRGLIGGHNNRPPGVPARFSGSLLGGKAALTLLGAQPEDEAEYYCALWYSDHWVIGGGTKLTVLGTPLGDTTHTSGRHGDEDTYYLQVRGRENFEILMKLKESLELMELVPQPLVDSYRQQQQLLQRPGGSGGA

SEQ ID NO: 154 - protein, 8 aa, Artificial Sequence
  Description of Artificial Sequence: Synthetic peptide
GYSFTDYN

SEQ ID NO: 155 - protein, 8 aa, Artificial Sequence
  Description of Artificial Sequence: Synthetic peptide
IDPYKGGT

SEQ ID NO: 156 - protein, 12 aa, Artificial Sequence
  Description of Artificial Sequence: Synthetic peptide
AREMITAYYFDY

SEQ ID NO: 157 - protein, 6 aa, Artificial Sequence
  Description of Artificial Sequence: Synthetic peptide
QDINKY

SEQ ID NO: 158 - protein, 3 aa, Artificial Sequence
  Description of Artificial Sequence: Synthetic peptide
YAS

SEQ ID NO: 159 - protein, 8 aa, Artificial Sequence
  Description of Artificial Sequence: Synthetic peptide
LQYDNLLT

SEQ ID NO: 160 - protein, 6 aa, Artificial Sequence
  Description of Artificial Sequence: Synthetic 6xHis tag
HHHHHH

SEQ ID NO: 161 - protein, 30 aa, Artificial Sequence
  Description of Artificial Sequence: Synthetic polypeptide
GGGGSGGGGSGGGGSGGGGSGGGGSGGGGS

SEQ ID NO: 162 - protein, 20 aa, Artificial Sequence
  Description of Artificial Sequence: Synthetic peptide
GGGGSGGGGSGGGGSGGGGS

SEQ ID NO: 163 - protein, 9 aa, Artificial Sequence
  Description of Artificial Sequence: Synthetic peptide
TPLGDTTHT

SEQ ID NO: 164 - protein, 15 aa, Artificial Sequence
  Description of Artificial Sequence: Synthetic peptide
GGGGSGGGGSGGGGS

SEQ ID NO: 165 - protein, 5 aa, Artificial Sequence
  Description of Artificial Sequence: Synthetic peptide
GGGGS

SEQ ID NO: 166 - protein, 75 aa, Artificial Sequence
  Description of Artificial Sequence: Synthetic polypeptide
  MISC_FEATURE (1)..(75): This sequence may encompass 1-15 "Gly Gly Gly Gly Ser" repeating units
  See specification as filed for detailed description of substitutions and preferred embodiments
GGGGSGGGGSGGGGSGGGGSGGGGSGGGGSGGGGSGGGGSGGGGSGGGGSGGGGSGGGGSGGGGSGGGGSGGGGS

SEQ ID NO: 167 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
  See specification as filed for detailed description of substitutions and preferred embodiments
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

The invention claimed is:

1. An antibody or antigen binding fragment thereof comprising a heavy chain immunoglobulin variable domain ($V_H$) and a light chain immunoglobulin variable domain ($V_L$), wherein
   (a) the $V_H$ comprises a $V_H$-CDR1 sequence of GYSFTDYN (SEQ ID NO: 154), a $V_H$-CDR2 sequence of IDPYKGGT (SEQ ID NO: 155), and a $V_H$-CDR3 sequence of AREMITAYYFDY (SEQ ID NO: 156); and
   (b) the $V_L$ comprises a $V_L$-CDR1 sequence of QDINKY (SEQ ID NO: 157), a $V_L$-CDR2 sequence of YAS (SEQ ID NO: 158), and a $V_L$-CDR3 sequence of LQYDNLLT (SEQ ID NO: 159), optionally wherein
   the antibody or antigen binding fragment binds to the IgC2 domain of CD33, or
   the antibody is a monoclonal antibody, a chimeric antibody, a humanized antibody, or a bispecific antibody, or the antigen binding fragment is selected from the group consisting of Fab, F(ab')$_2$, Fab', scF$_v$, and F$_v$,
   and optionally wherein the bispecific antibody binds to T cells, B-cells, myeloid cells, plasma cells, or mast-cells, or wherein the bispecific antibody or antigen binding fragment binds to CD3, CD4, CD8, CD20, CD19, CD21, CD23, CD46, CD80, HLA-DR, CD74, CD22, CD14, CD15, CD16, CD123, TCR gamma/delta, NKp46, KIR, or a small molecule DOTA hapten.

2. An antibody or antigen binding fragment thereof comprising a heavy chain immunoglobulin variable domain ($V_H$) and a light chain immunoglobulin variable domain ($V_L$), wherein:
   (a) the $V_H$ comprises an amino acid sequence selected from the group consisting of: SEQ ID NO: 2, SEQ ID NO: 3, SEQ ID NO: 4, SEQ ID NO: 5, SEQ ID NO: 6, SEQ ID NO: 7, and SEQ ID NO: 133; and
   (b) the $V_L$ comprises an amino acid sequence selected from the group consisting of: SEQ ID NO: 9, SEQ ID NO: 10, SEQ ID NO: 11, SEQ ID NO: 12, and SEQ ID NO: 13, optionally wherein
   the antibody or antigen binding fragment binds to the IgC2 domain of CD33, or
   the antibody or antigen binding fragment is a monoclonal antibody, a chimeric antibody, a humanized antibody, or a bispecific antibody, or the antigen binding fragment is selected from the group consisting of Fab, F(ab')$_2$, Fab', scF$_v$, and F$_v$, or
   wherein the bispecific antibody or antigen binding fragment binds to T cells, B-cells, myeloid cells, plasma cells, or mast-cells, CD3, CD4, CD8, CD20, CD19, CD21, CD23, CD46, CD80, HLA-DR, CD74, CD22, CD14, CD15, CD16, CD123, TCR gamma/delta, NKp46, KIR, or a small molecule DOTA hapten or
   wherein the bispecific antibody comprises an amino acid sequence selected from any one of SEQ ID NOs. 30-113 or 142-153.

3. The antibody or antigen binding fragment of claim 2, further comprising a Fc domain of an isotype selected from the group consisting of IgG1, IgG2, IgG3, IgG4, IgA1, IgA2, IgM, IgD, and IgE, optionally wherein
   IgG1 comprises one or more amino acid substitutions selected from the group consisting of N297A and K322A; or
   IgG4 comprises a S228P mutation, or
   the antibody lacks α-1,6-fucose modifications.

4. A composition comprising the antibody or antigen binding fragment of claim 2 and a pharmaceutically-acceptable carrier, wherein the antibody or antigen binding fragment is optionally conjugated to an agent selected from the group consisting of isotopes, dyes, chromagens, contrast agents, drugs, toxins, cytokines, enzymes, enzyme inhibitors, hormones, hormone antagonists, growth factors, radionuclides, metals, liposomes, nanoparticles, RNA, DNA or any combination thereof.

5. An antibody comprising a heavy chain (HC) amino acid sequence comprising SEQ ID NO: 16, SEQ ID NO: 20, SEQ ID NO: 22, SEQ ID NO: 136, SEQ ID NO: 139, SEQ ID NO: 141, and a light chain (LC) amino acid sequence comprising SEQ ID NO: 14, SEQ ID NO: 18, SEQ ID NO: 24, SEQ ID NO: 26, SEQ ID NO: 27, SEQ ID NO: 28, SEQ ID NO: 29, SEQ ID NO: 134, SEQ ID NO: 138, SEQ ID NO: 140, optionally wherein
   the antibody binds to the IgC2 domain of CD33, or
   the antibody is a monoclonal antibody, a chimeric antibody, a humanized antibody, or a bispecific antibody, and optionally wherein the bispecific antibody binds to T cells, B-cells, myeloid cells, plasma cells, or mast-cells, or wherein the bispecific antibody binds to CD3, CD4, CD8, CD20, CD19, CD21, CD23, CD46, CD80, HLA-DR, CD74, CD22, CD14, CD15, CD16, CD123, TCR gamma/delta, NKp46, KIR, or a small molecule DOTA hapten.

6. The antibody of claim 5, comprising a HC amino acid sequence and a LC amino acid sequence selected from the group consisting of:
SEQ ID NO: 16 and SEQ ID NO: 14 (chHIM34×CD3 BsAb);
SEQ ID NO: 20 and SEQ ID NO: 18 (BC249—hHIM34× CD3 BsAb);
SEQ ID NO: 136 and SEQ ID NO: 134 (BC275—hHIM34×CD3 BsAb);
SEQ ID NO: 22 and SEQ ID NO: 18 (BC267—hHIM34× CD3 BsAb);
SEQ ID NO: 22 and SEQ ID NO: 24 (BC268—hHIM34× CD3 BsAb);
SEQ ID NO: 20 and SEQ ID NO: 26 (VL3VH5×mC825);
SEQ ID NO: 20 and SEQ ID NO: 27 (VL3VH5×hC825);
SEQ ID NO: 22 and SEQ ID NO: 26 (VL3VH6×mC825);
SEQ ID NO: 22 and SEQ ID NO: 27 (VL3VH6×hC825);
SEQ ID NO: 22 and SEQ ID NO: 28 (VL4VH6×mC825);
SEQ ID NO: 22 and SEQ ID NO: 29 (VL4VH6×hC825),
SEQ ID NO: 139 and SEQ ID NO: 138 (mouse VL-mouseVH×mC825); and
SEQ ID NO: 141 and SEQ ID NO: 140 (mouse VL-mouseVH×hC825), respectively.

7. A method for treating leukemia in a subject in need thereof, comprising administering to the subject an effective amount of the antibody of claim 6 or a bispecific antibody or antigen binding fragment comprising an amino acid sequence selected from any one of SEQ ID NOs. 30-113 or 142-153.

8. The method of claim 7, wherein the antibody or antigen binding fragment is administered to the subject separately, sequentially or simultaneously with an additional therapeutic agent.

9. The method of claim 8, wherein the additional therapeutic agent is one or more of alkylating agents, platinum agents, taxanes, vinca agents, anti-estrogen drugs, aromatase inhibitors, ovarian suppression agents, VEGF/VEGFR inhibitors, EGF/EGFR inhibitors, PARP inhibitors, cytostatic alkaloids, cytotoxic antibiotics, antimetabolites, endocrine/hormonal agents, or bisphosphonate therapy agents.

10. The method of claim 7, wherein the leukemia is acute myeloid leukemia (AML), bi-phenotypic leukemia, bilineage leukemia, myelodysplastic syndromes, chronic myelomonocytic leukemia, myeloid blast criss of chronic myeloid leukemia, or acute lymphoblastic leukemia.

11. The antibody of claim 6 or an antibody or an antigen binding fragment comprising an amino acid sequence selected from any one of SEQ ID NOs. 30-113 or 142-153, wherein the antibody or antigen binding fragment is bispecific and binds to a radiolabeled DOTA hapten and a CD33 antigen.

12. A method for selecting a subject for pretargeted radioimmunotherapy comprising
(a) administering to the subject an effective amount of a complex comprising a radiolabeled DOTA hapten and the antibody or antigen binding fragment of claim 11, wherein the complex is configured to localize to CD33 expressing tumor;
(b) detecting radioactive levels emitted by the complex; and
(c) selecting the subject for pretargeted radioimmunotherapy when the radioactive levels emitted by the complex are higher than a reference value.

13. A method for treating leukemia or increasing sensitivity of leukemic cells to radiation therapy in a subject in need thereof comprising administering to the subject an effective amount of a complex comprising a radiolabeled DOTA hapten and the antibody or antigen binding fragment of claim 11, wherein the complex is configured to localize to CD33 expressing leukemic cells.

14. A method for treating leukemia or increasing sensitivity of leukemic cells to radiation therapy in a subject in need thereof comprising
(a) administering an effective amount of the antibody or antigen binding fragment of claim 11, wherein the antibody or antigen binding fragment is configured to localize to CD33 expressing leukemic cells; and
(b) administering an effective amount of a radiolabeled-DOTA hapten to the subject, wherein the radiolabeled-DOTA hapten is configured to bind to the antibody or antigen binding fragment.

15. The method of claim 14, further comprising administering an effective amount of a clearing agent to the subject prior to administration of the radiolabeled-DOTA hapten.

16. A recombinant nucleic acid sequence encoding the antibody or antigen binding fragment of claim 5, optionally wherein the recombinant nucleic acid sequence is selected from the group consisting of: SEQ ID NOs: 15, 17, 19, 21, 23, 25, 135 and 137.

17. A host cell or vector comprising the recombinant nucleic acid sequence of claim 16.

18. A composition comprising the antibody of claim 5 and a pharmaceutically-acceptable carrier, wherein the antibody is optionally conjugated to an agent selected from the group consisting of isotopes, dyes, chromagens, contrast agents, drugs, toxins, cytokines, enzymes, enzyme inhibitors, hormones, hormone antagonists, growth factors, radionuclides, metals, liposomes, nanoparticles, RNA, DNA or any combination thereof.

19. A method for detecting a tumor in a subject in vivo comprising
(a) administering to the subject an effective amount of the antibody or antigen binding fragment of claim 5, wherein the antibody is configured to localize to a tumor expressing CD33 and is labeled with a radioisotope; and
(b) detecting the presence of a tumor in the subject by detecting radioactive levels emitted by the antibody or antigen binding fragment that are higher than a reference value.

20. The method of claim 19, further comprising administering to the subject an effective amount of an immunoconjugate comprising a radionuclide conjugated to an antibody or antigen binding fragment thereof that comprises a VH amino acid sequence selected from the group consisting of: SEQ ID NO: 2, SEQ ID NO: 3, SEQ ID NO: 4, SEQ ID NO: 5, SEQ ID NO: 6, SEQ ID NO: 7, and SEQ ID NO: 133; and a VL amino acid sequence selected from the group consisting of: SEQ ID NO: 9, SEQ ID NO: 10, SEQ ID NO: 11, SEQ ID NO: 12, and SEQ ID NO: 13.

21. The method of claim 20, wherein the radionuclide is an alpha particle-emitting isotope, a beta particle-emitting isotope, an Auger-emitter, or any combination thereof.

22. The method of claim 19, wherein the radioactive levels emitted by the antibody or antigen binding fragment are detected using positron emission tomography or single photon emission computed tomography, or the subject is diagnosed with or is suspected of having cancer.

* * * * *